United States Patent 9,481,889 (GENE CONTROLLING SHELL PHENOTYPE IN PALM) - sequence listing, part 3

SEQ ID NO: 8218 - DNA, 3391739 bp, Elaeis guineensis (residues 1,695,871-3,391,739 of 3,391,739)
  3.4 MB genomic region of shatterproof1 (SHELL) shell thickness gene
  modified_base (1)...(3391739): n = g, a, c or t
caaattattatacttaaaaattgtaaaattctcccgaatatcaaaatgcagaaaaattgtattaccagcatcattagaagataggaggagatgatttcaatatgcttatacatatcactgtcttttatgcatgaaaatatactaggagatagcatatatcatatctaattggtgctataactgtctttcatgcatgctaatatcttaggagatacatatattatacttagttattccaatgatattgctacatatacacatataaaggaaccacagtttgtggtcacattgtcaaaggatagatacaaagagatacctacatggtgcttctcagtaaaattatgtgttactaaaactttatcaaagataacattagtgtcatgtctttctctctccctcccattgtccccatataacaattcgaaactcgagagagactatttcgtcgccgcgtctcgttgcattaaagcttgcactcgtcctcctctctctacggtcctccgcgtcttccaacctctctctccaatcccccgtctctccgaggccgatctggggatctcagctctctgcggcaatggacctttcttcgagtctcagctcggtcgcttcgtttgaaagatcggatttttctcatctccagaaggccagatcctttcatttctaatgtttcgatcgcaaacacggccaagggagctcctcttggttcgtttccttctctaaatcgtcggattccattttgtttttctcttttgcaatctttcggtgaatctcgaaagttctgatgccaaaaggaaagtatttgattctatccgatatcttttttccagggtttctcagtttccttcgaagagactggaatttcggggagattttctataaaaaaaagggcttcgaagagttacggatcggtttatctgcatttggttccaggatttcccatcggtttctcttcgaaagtcgattcctttgagataatcgagcttggaaacatcgagtcatggacaagggcaaggccccagtccatggcgaaggtgccggttcgccaccccattcttctcgcttctctgcttctttctctccgttctcgagcaatttcccagagttgggcgatcccttgcgttcatcctcctcgcagcctattcaagaatccagccaagacgtcagcctcatgccggatttcttaccaagaaacctcggccaccgccgagcccactcggatatccttggcctcccagacgacatcagcttctacagcgacctcggtgtcgttggatcccatgatgacatcgatgatgacttgctctccgcttacttcgacaacgagaattttaattctcctcctccctcgtcttcgggcccgtcatgcggtgagccttccggcttggcggcagctcctcctgctcctttgcagactgagaatctggtctcggcttcgaatgagaggccaggggctgggcaccagcatagccagtccatggatgggtccttctcggttctgctgggtaccagcggtgaaggaccgggactgacaccggcagagatgaagaaggctgtggaggatgcaaagcttgctgatcttgctctcgtcgatccaaagcgagcaaagaggtttggctgatcaattgcagtttctcaattgtctttctcaataatatacctctagcattctgaaggtttaccttgaaactaaacgcaattacacttgagatacctgtagcactggattttagtaggtgtcaaacaggtgctagatgttaatctcagtcttcctaggatatgaagaacaaagtatggggtgctaatttagaatataggatacttaaaaggagaagatgtagagcacttaagaaatatccatgcttccattttcccactactcttcaatctgcttccttgcccttaggatgattgttaggtaaaaagaatcataaatccatgtgtcttgataaaacaagatacacagattagttgcattagatctaccatgctagttaatcttcctcaattccggcagttgctaattacatctactgatgttcagaactttcaagtttgtttttcttcatggcaggttcatcatcatctctaatatactattgtatctgtgagtgttgtttggttataagaatctagttccaccatatgtaaaccccagtgatgcaactgttggtggcatcttattacatgacaaccttgttcttgtatgcgcatgcagatctacagctccttgcctccttcctatatttatcatccctaagcttgtgcaccttaactttggcctttaatccaaaagccctagattatatgatgactctgatttcatagacagataaacatgagacaagttgctctttagttttgctttttcagccatttcacaatagtaactgcttttcatagatttttgctattgttaattagtgttattatttggtaaacatttcactgttcatgacattaagaactagttccaggtcatctttaagtaataacataacatccgctcatttttatgtaatctgagatgaccattctaaattgaaatttgcaatttgtgactcttcctttattgtgcatctcaccactacatgcatattcaagttgcatccacccctatcagatgcctttcaaatatctcttcatcattatctgtaagattatttttgtgcagattttgttcagttgtaacagtttatgctttctcacataatcagtcgatgaataaaaagtcaatatgccatcttaaaataataagcacaaaattttcttctgttacacccaaatcatgtatagatctcttgtgctgcaacatctcttcacatgcacctcttctagttgatgtgctttgtagcttgtttgtagatacaacttttgccacttttgctttaattagaagtgtattgaatcttttgaaagatttaatttgtgtcaattcttttgatggactcatgaaaattttacattctttctgcacactctgtgtggagatctcccaagatgatggagagatgtagtgacccaccgatcatgtacacattcatacacaagcatgccaattaagatttaagaccatgcttctttttataattactttgcttattttacctacatgctctatgatgaatagtcttttgctgctgatgttgaatcacatgcttaatattaaagttttaaggatcatggtatgcagttgctaccattatttatgcactgcatttaaagagctccaagtcttgaattcaaccacaataaacagtgcaccttgatggagaatgctcgattattttttatttaatgttcttaataggacattttaagttgtatttaaaataaatatataaatcttccatggtgccaaccagatgattggttctatgtgcattttgtgcccatgcttcatttaccaaaactcctctttcaggcaactaaagttatcctgtacatttaggtccttcatacaagttgttcagatacatcatgtcatagttgttgctcagcatctgcatttttttaaaaaaaaataaaaaagatattgttaatcttaaaatgtgcttaacctacatttatctttcctgttcccaactttctatgtgacgagtattttggtgggatggataggatgtgggcaaacaggcaatcagctgcaagatccaaagaaaggaaaatgcgttatatttctgagcttgagcgacaagtgcagagccttcaaacagacgcaacaacattgtcagctcaattaacaatgttacaggtgcatacatctccataattgtttcatcattatatgtgtgtgcacctgcgtgcgcgtgtggtttgtgtgtatatcgaatttgaaatatgggaaaaaggattctttgctagtccaaaactccaaagaataggagaacttgcaccatcccacccttcactatatatcattccttcaagatgcaagtgagaggcattgattaatcatattgaatatttgaatgtcggatctacttacgtatgattcttcattggcagctgagaatgcaagatgtgaagtttatactatttgatcttatgtaatggttaaaaatctagtgtttaattggatctagttttgcagtgctgctatatactactactacttccaagtccccaaaatcccaatagtaaatatataaataaaacgtttgcctttaagttggtagaactattccgtactaatgagaagttgggaaataggaaatgccatattaaaaaaaaaatgtaagaaacaaaggagatacggatatcttggcattcttacctttccactgttaatttcttcttctttcggcacttgacgcactattcttttgacatttttccttcaagtaacactatattctctataagcttttagacaactgaattgattttatttacctggaatatttactgagaaaactaatagatagggaagtgggatacctgtttcgtataaattgattgttcagaggtcaatgttctatacccatatatcctttattgtcttgagcaattgttatgttacaatcttatatttttttaaggattgccaaaattaggctacgcatatgcattgattagaaaattctcatattggcttgtaattacagagagacaccaatggtctgactgcagaaaatagtgagctgaagctgcagttgcagaccatggaacaacaggttcactttcaagacggtaagttgtttgtttttttttttaaaaatacttttttacatttggtgttgcgaatctcttcttattatctccttcctgggtatgcattgcattttcatttagatctttggttttcagcatcagtgtgaatgtggttcccctcaaaaaaaaaaaacaaaagaaaagaaaagaaatgaagaatctagtagcaatgcacttgtcatttgatctgttaaatttcaatcggtcattcattatagtaacaatggtaacaaaggaagcaacactgacttgaagaaaatagtggtgttttagaagctactgtatatgttcaaggatctccaattttgtcacctctaggaatattagactatttgatattttgacatttttttgacattcaaattttgcttgcttacatatatcatcttcttcctatttttgttgctaaattcttactaccacttcatttttgttatcacattcacatccttgttatttccttcctgggttttcattctttggttttcagcatcggtgtagaatgtgttttccccactaaaaaggaaatacagaatgtggtagtaatgcgcttctcatttaatctgttaaatttcaatcggtcctgcattatagtaactatagtaaccaaggaagcaacgatggcctgaagaaaatagtggtgttttagaattcactgtacatatgaaagaatcttcatttttgctactgcgaggaatgttaacactattccgcatttttgacactcagattttgcctgcttagatatattatcctgttttccaaagcttatgttctttattcgtttagctttaaatgatgcattgcaagaggaggttcagcggctgaagttagcaacaggccaattgatgccaaatggtggtccaatgatgaattttggacacccttcatttggagcgagtcaacaattctaccaccataaccaatcaatgcaatcactcatggcagcccaacaatttcagcaactccacatccactctcagcatcagcagcagctgcaccaacttcagcctctgcagcaacagcagctgcatctccaccagcatcagcaaggacagcagcagccacctgtagacctgaggatgaagggtccaatgacttatcagaacaaaagggcggagggcccatcagataacaataacaatcaaagggagtgaggaaaggtactgggaatcaatagctatccaagtcatatctataccatgtaccctgccttttattagttatagacttggaaccattctcgatatatgaggttcattaagtttgattacctctgttggtctgctttccagaatcatataaatgatggtgatcttccaaacaccaaacaacacttttgcttggcgtggctcaccatttcaataaatatgttgtttcacattatatatcgttggtttattgattcagaatttgtcttggtgaaactattttgtgctagcctgaatattagttcactttgtcaggcatctgagtggtattgaaagttggtgacctagttgggaactaattttattaattactataatctttcttctttcttgtttgatatgtcgtattgttttttttttttttttccctcacaaagtcagctggttgcattctaagcggtgcttgaggctgtttccatcaaatggagtttatcagctataacctcctatatttcaggagggatcggacaattgttggcaatgcccagttcacctttactatattcatttctgcattcttttcgtcaatacagatgctttcaggtctggttggattccaactccacaacatcttttcttaaagaaccatgtatggcttctggggcagctaatagtttgatgtatctgatctactgcaatccacttacccactgccaatggaggtttctcatgatgacaaccctacagaccattccagccgctgcctgaccattctgccttccattttatccacctccgttgatcttgatccaagcgagtgaaagagacatggcccatgtttggttgggttggcctgtttcactgaactagtcaattttagggatgtgagcagcttgtcttttatccaatccaagcaacacagccaaactcaatgacgcataattaagttcgtattttttttatcagattttgatttggatgatccattatgggatggtcaataaatttgataaatttcagaaaattactgttttctgtttctttttctctgcttcattttggcctaaacatcctccaaaacaggtattgggcatccagcgctactgcatctactctctggatttcatccttttctcctgatgttccttatcatgtaattgtggatggatgcttcccatgcaggccttttaagggcgcacacgcacgcacacatccaaaaaaacccctttttcattttgtaaatctagtttcacttgatcgagaccaatattcatagcctacttcacaaaaaataattttaattatccttaaacctacagtctgtatgtgaatgagaaaggaaattgacatgcaaaacaaaatatgaagcagccattttggagaaatgatgtttgatatataaaatttctgttaatacataatacatgtccatgcatttgtgcatgaacatcattatgagattgtccatcagtttttttttttttttttaatcagatatagataacacctaaacctgccccaataaactatagattattgaactatcagaaatatttagtcagatttggtttctgaattattgggtattacttaatgctctactcaattttcaagcaatccatagcttcatgtagttaagttgatgagcttgttcgatgacaaagtctccctcaagcccgcctttcctatggagcagatgttttacattcctgctgaagatggggatcaggcactctaaagcaaactgcataacactcttaatgttgccccccattataatcatagaggtagggaggaccaggatgtgggtcatagattgacagcagggaaggagatcacaaattatcatgcaataagttttaaagagacctcctcgttttttctttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccacagaaccacttaattctattgaacttgaatctgcatcgcattgtacttcatagccccatcacggcagccacagctgtgtattaaattggtgctaatgtaaacattgattcattgctcgagtctagactttctttggatctgtacttgttgaaaatcctgttcacctgttattttacaatagatcatggcatttcacagttggaagcaagtagtagtagctggttggagaaaaccacagcaaaaatgccatgaaggaaaataatgaaactagagaacttcaagcatagaaaataactttctaatttcataattgtaggactacttgttttcctcaaacatctaaagagtttgcatatggaatcaaaattctttttcaaaaacatacagattagacttgactctaaagttatatgcaacttggtggtacatccaaataaagcattattttgtcatcagtggtatctatctagttgccgaaaaatgaaggttgatcgagaaataaaacttatagacttcttaattgtgtccataagatcatcaacaaaattcctggttaagcaaaattcaggtctttcaattcttctaggccataagcttttagtaaaaagcggtttacctgagaatacattttgacaacaaatctaactgtgtttacacccaaacactaattggtcatcaacaaactatagtaaatgttcaaaaacataaatgttgatgaagatttggtcaatcatgtgcatgatacttgaaggaactgtttttggccatttgtcattgatacaagaaataatatgtgggtagttaattgctggaattaacgtgttaaaggaaattatcaggacaagagggttattcatgtaggcaaccactgataaccactaagaagggagtttatcaggacaagaaaccatcagaaggggtaatcattgctgaaaataactgccaatctgcataataatatggaaaagaagcttcatttggacccacactatagacataacaacttgaccatccaggtattggagaaggcttctacaccaccttcgtaccatgacgagtgtgagctgactcagcatccataacatggtcaaaagctctccaatgcaatatcccattctatcttggaggagtctgcccaggcatcaagagtattctgcatcctaaactgttatggatttatatcctatcatctagcacaacaaccgttcctctctggactcaaatgttttctcaattccatctgactgacccacttttcgcaatagacagcatgctctcagcctccagctagagacagtatgagtattacctgtgaagattctatgtaagtgttctatctacatcaaatcttttatttggattgacacaaccagacaggctgacctggacgtgcttatacctagcatttcccccattttaggaaatgaaatacaaacagtaacaagaagctcagaaaccttaggcaacatggctaaggctacaagaatcaacagttaatctaaaaaaatatatagcataattagctaaagcttaattcctctgaaactccttaactatcagttaaaagaagaaaatctgcattcagaataaaaattatctgaatgttggatgcagctaatggcaattctgtgatatcaatctaccatcccattttgacattacgtcatgatagttggaaggagataaaaacaatgaaaggcaatgatccacaagtacagaatggatagcattcattgtcatggctgcaaaggaaactctctttaactatttttcctcaacttttacaatagcacgtctcaaaaacatggtaactggattcaacaacatagagttgctctacctgaagatattgtctacaggaaggagaagaaaaaacacaaaactattcacaagatgccagtatatatccacaagtgaattgtaaattaatgatagtggcatgtttcataagatgaatgcaacatcaaaaacaacatattttgttaattagaaatatgcgactcaccaaaccaaaatctacacttcaaagtaatcgaaaattgaaaagactattctgaaaagatccacatgtcagtctttgagatccaaaagaatttttcacctggaacaggaaccaggtgaaagacgcacaatttctggtttttagaatccatgttctgaccaagcatggtgcttacagcagggaggacctcttggaataagcttgtccaatgaatacagcaccacacaagtctataaattgggcagtgctgacttctagcatatgcacgagcagacaatcttgtatgatggaccaatcatcaatggaaaaaccacatgatctcaactgtaagctatacaagttctgcacctctaccagtaagaatattcatctgcagagttctaccatttccagaagcaagaaagcccacagtaggtagtgaagaatccgtaactgattcaatctcaataaaatttaagtcaaaagctccaccacgcttgaggctcaggaaaaacaccagaataatccatccaagcattgaaatggcccagtaattactcatgccatgaatcaaaccccaagctatggaataaccgacgataattcctgacaagtggccaataaaacttgcttgtggaacaattatggacgtgaaaattaatgattcaaatggtgcaaagctgattggcagagaaagaaacccaaacagattcagctttgaagatggctgcttcactgcaaggatcgtcatccatccaaacaccacacatgagtaaccaacggctgtcactctcctgaaatactccaacttaaacttctgaatcagaatatgataaactcccaggaccagcaatcctgataacactaccagaactagagtataatggagataaaactctatgccaagaccaatgtagcccaactgctcaaccatgccaaggctccaaagagcgctcatgttaaaaaccagatgaaccacgctgatgtgggagaatgcggatgtaattattctccaataatgcccttcaatggctgtttcatagctcaagcccacactggcataaccgatgtttttcttctgaatgtagaaccaaattgcagtgcatattcctatgatacaactagttgcaggtttttcccaaatctcatacaagagtggcttccccatccctcactatccacaaaatttgtgcagcagggctccaacagatcttcagccttatgcaaagccacaatctacaccttacagcaggaaaatgctatcttcacattttcccaagcaatacaaacataacaacaataaatcatgaagtttttgaactcttcctgctcaatcccactaaccaataaaattcgaagagaaatcacttgatatctcgcatattatgaagtctgacttacagctgaggtttcccctgatcaatccagcactccacaattctcaaaaatgttattcaaacaaaaaaaggttgttatatgaggtccaattctcccacatgaacagaaccagagtgaaggataacaaccaatcattcaaatctataaccacactccagactatataaacaaagctccgaacgcgcaggctcgaattcaaaatcctacattcaaaacccaagactgcgtaatcagtcgcaacattatgacttccaacctcagcacataacgttagtattcgtcgtctatatactctacttttgtttggataaaaagaatctctttagaggaattttttccaaatcaacacagctttcacattcttatcttccagacagtaaatcgaattggctgattgaggtaattaagcagttcgattttatgattatatatagaaataagttgcagaaagatcgtagctttcattagatggatagatcacgagaattctaaaggggcggcgggggggggcgggttgaaagcagatcgcatcccctaccttagtttaaaggctctagagagaagaatctatcgaagcgaacaaaaagagaaatcggtgagggagaaaaggcaaaggggaagaggaatagagaatctagggtttcttgatcagagaaatggactaaaagaagaggaaggttttgagatctttaccgtacctcgggtcggaagtccgctgctcgagaactgcctcgccccaaatccgtagctcccttttcctaccgttcttttcttcctcttcttttgcttcttcggggagagcacccaattgcgtgatcattcactgctggtcgttgatcggtgaaccgtctaggctaaccggttcgaccggtcagagacgggctacaaggttcattcagctggacatgagtccaagtataaacatttttgaaagcttgcctcataaataactcaggtttggacaacttaaatttatttaaaaaaataataagctcatttaaactccagcaaaaatgataaataaaataaatttcatatatatatatatatacacatatgtgtgtgtatgtatgtatgtgtgtgtgtatatatatatatatatatatgtgtgtgtgtattgttgcggtacaaatccctaattcatctagctctgcttaagagcaatatgacaaaacatgtccacactgatacgaaatttatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgagctagaatgcatgataacaatcatatttgacctcccctcttatgggcatgaatgctcttaaattactgatgcatggagaatcatctaatcaaatgattttgcaaatgatgtactgataaaacctatatatccactttggtcaagtgattaactcttatctatagtgtacagtcctttacctgattcaataagactggtaattttttgttgtgttacttcttatgtttttaaaggtggtgcaacgataaattatgaaagtaggaaaggcaagaattttacactatttggataaacttgcaatgatgctacataaaattttgatatgctgagaatcatgaatcatgctttctttccactggtgtctgtagcataatcttcttcataaaaacaagcaaatagatgaggactttgataatattttatctaatgttgtttcttgggcagccatctcctttcaataagatatagaatttaactttctactcaagagaatcaattgaagatcccatctggattaacatcaacctgctcttgctgcagctctgtcgatgtatccttcttgcatatgttgtttttttcctgttccatatttagctggcattttctgtcatttcattaatattctgcttgctatatcttgttctcattctcatgctggcagatgcattattcagtggaaatgcataattagctctgactcactcactccaattaaaaatataaatctcacatcatcatgccatgacaaaataaaatcttgcatataatttgatatgtaattccacttgtccaagaatttccatttaccatcatatgtttcccctcttcacaattaaaacaaaaacgactgatgaatccgattcattgcatccttcggagtgttaacttttttgatgaaggctgacagtttttgcagcatcatctattgctaggaagtgatgattagaatttctcaaaaagaactccctgggggctcactgatccatcaaactaccaaattggtctcctccggacaattttgttggatgagagacttgcacaacagccatatatttagttatgttgccagataattaaaagctaaaatagatatttagatcagttaactgctcgcaaccgatggcgaaaaatattagctcttgaagaggagttggaatttggagagagacaatggttactatgactgacatgctcatgccggctcatttgcctcagttccatgcacatttgaaacagaatgcatcaaagagggaggggggggattaaggcaacctattgctggaatttatcaccaaacattccagaggcagcattagctattgtaggctcaaatttacgggcaagctggggtgcatggcatgactaccaaagagccatgttctgtgagaacttgtttacttcactaacctaatctgaaacatagaattcagtccaaaaagaaacaactctgctatttttctgatgtcaagatagcattaataactcctttttttttttttttggctttcaatatgtcctcaaaggacaaacaaaaaatatactatatgtactctttagaagagatcccccattaaagacacaaagaccaccactgcagccaaagccattggcagaaggctaacacgaaggcgatgcccatctcctcttggaatttcatctggcaacgagcattccccaccattgaagaacaccctcgccgggaacccgtccccccttggaacgtctatacccggcgtgcgccgcttcgtgaatgtgatcactgattgttgcttgcccggcaaccttggatccttcgtcgggttcttcccatcggtctctggcatcaggtaattcagaccctccaagccttggaagaagatggtgtttttgggtgtcgtcaacttggtcccattgaatgagtacaccttctcatagccatcataagctttcggcatctgaatagctgagaaccagtccctgaaagtgtactcctcccaattgaatatggtgatcctcgccgaccatccgttccgatagtccgaagcaagatgccagttgatgctaactccacaggtgtcccagcaaggcatggggttcggtagagcgaagtgtttcatcttagcccaagctttggccttggctgttctgttctctgatggaatcagcagagcctccggtggcagcaatgctgcacgggcatcggggtcgcaggtatctgtgtccgggcacccgcaagcacaggagctgcatgggatcgccgagtcgttgtaataggccgagaaggagacgcagcaccgcgatttcttcggtgcaggccttgatatgttgcagaccacctgccaactagcaatggcatagctcttggccatgagaccgctcgggtccgggaactccattgggctcactctgaagggagggccgcaggtgtactccggattgagctggccggtgatcttccagttgtgaggaggatacagcgcagtccggttgaagtcgggcggcatcttgaacacctgaagctgaaagatggccttggacttggttatgtccatggttggtggtaagagggtaccattcttacagcaataaggtatcttgccaatctgtgtatcattggctctctcgggaggcagatcggcgatgatgggcttcttctggcagctcatgacattgctgaagtcgaaatccttgtagaacctcccggccacaccgtagatgcattcggatgcatcatgcttgagggtgtaggcgcctctcatgctgttgatgaattccccacgcttccactcccatgtgaggttccaattgtcgagccggccgagggggtggttgttgtcgagggtcacttgggcaaggtaattgtttccataggcctggagcacatcgtaggcgatggtgaggtcgccataccggcgcggcaagaacttggtgggaggaagcttcttggtcttggatttcttatccttgacgcagcacacatacatctggcttcctgcatagcaatgagaggagaacgaacaagttcttatattatctcaatgctaaatttcctaactaaaaaagatgagatggattcatagttcactttgtatctatatctcttcaatcagatcctcaggtcacactagaatgtcttcgcataggaaagctgcaagtttttagacaaccatatgtttctggttgtattcacaaattccccagtttcacctgcaaactattctaaaatttacaaacatatgaatgcttcaatccttcatcacctccattctagtgcaaacattgtatttttatcaccgaaaaaatgctggttacgaattttgtgtctagttactctaatctgtgcatccagtaactgtaatcaatcagttctaattatggctgctttccagaccattccaaggcatcagggacaagcttccgccttgccaaagtctactaaattttgatgcattttgttgcaccattaggatgaaatctcgagaaccatgcatcagcaattatctgtaaacagttcgatttatgaattccattaattatccatagcttcatcattgagcactcatacaatcaaaaaaaatcatcgaggacataatttatcataaaccatctgtgtttatttgacttcaagtgtcatttgtttctacttggcttctcctatgcttgttttctttaattacactctttctgaaatataatttttctcttattttcttctcctccctggacttttcccatactgtctgtcttcatcccaaattatgacctcgttctttttgaactgatgaatcctaaaatcccaaacaagaatcaacaccaactaggctttcttcaaatctgtagaatgcttcgaccaatcatcccttttcaaatctttcttccatctcatgccaatgcaagccaatgactcacagaactaaatgcgatgcttacctttaagagccggctttgggcacttgaacccatcattttgcagcttgatcgtcttcggcatcggtatccccggcggcttcaccccaaacagcgttcctgttatgtcgatcttcaccatcatctgattcaagtcccctgcagtatcaacggcattcagcaaatctgcctgcggggaccccgaaaacgatgtgccattctccacatgagcagggaagtcggtcccatcggtgatcaccgccccggaagccgacaccaggatctcccggtgctgaaacccgatgaagatactccatgccttgaggtcctccgtcatggtgttgagcaccgtggcggtcgacttgaaggcgtaggattgggccgtcgcattcttgacataagggtattccctctctcgagaaaggaagtcatatgtcaagaagataccgttgcaactctgtgcagccttcggcagctgcccggatttttcatcgccgccgccgtagtcatcgtagtcttgggctagcacgccggtctgaattaggatggagaagaagaatgccgcgaagagaagggatctccagggcggcattcttcttgggctgtctctgaattggtgatctcagagaggagggtggaggaggagatggcgagacatggcgggatttgaggtggttgggtggtggaagggagacgagtacttgtggtgtatggtctttgtgaggggttttgtggaagtggtggtgctctgttgcggcttctcgtttcggatttgccaaaaaaagggtatttggttccggtgaaggagatgaaatggaggacttgggagaagaccttgtcagctttgttctcctcccctcaagttcaaccaacaatttggagggaagagtcaccaacggcccttgacatcttttttgacattaatacctcagcacgtgcaaaccgcatgaccaaatcaagaggaaggaatatgatatattaaaagggctttaatccaaacaatataatctttttaattagttcttttttctcttagattcaagtaactttacaatgataatagatgaagtttattcaatcattctccttatttttatttttatttttattttttttttgagttggattgctaggtaagggcaggtggtagtggtgttggtgttttttttttttcttttcaatttttttcgagtgaaagcagcataaaagttactaggtaaccaataaattggcatagatcaaaaaattttgattttgattttggatcaatgaagttgccaaattagattgcatatattaaacctaaaccatttacatgtttaatataatttttctaaagtgttttttatatagaagaaagaagggaagatatttatctaagtttaaatacttaacaccaaagaatctaattgaaacatctctttagagaagggttacaatcattatgacaatacctactttattgatatatttgatattagaaaattttacataaagatttatttagttattgacttgtcaaggtaaattgatttttttttttttcagaaatgtgcttatttatggctcctcggatgatctggcctttgcatctgagtatgagatatgaaatatgtaaatttaaaatacccaatacatgtattttggataaacaagggggtgtctatgtatttgtttgtgtatagcacaatgggccgagtagctggtggacacacagtcattgctgcaaagaatgcgaagctaaaagacgaaaactttcggcaagtcacccaataggaccaagaccgggcctaagtatcgcgttgaccgtggatgtgtttgcctatccaagtatcgcattggaatattgtgtaatgattggaagattggatctctcttacctccaccttgaactaaagtccagaggatccatattcagatgattgccttgaagaatattggtcggccaccgccccttactgcattaatcatgccatcaacccatccttcctttttaatatgttacatttaaaatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgtagtctataaatattatgagatattgtttaaatattatgaaatatttctttgagtttttcatggctatccctttttttcttctttttttaagaggaagagaaggtgaccgtggccttattttttcaaaaataataaagaaaaacataagagtacttaaagaaaactacatgattaattagaagaaaaacaacaacagaaaaatctacaaccaaagaatataggggcttgggcaaaaaaaaagatatgtagaggataattaatataaatagaggataccttccctcaaatggagtagtatagagattgtcaaaaagtgttagtgctattcgtacatgatgctaccaggtcatttttgttaaagagaaagatcttcctattttcaatgaatgattcgattagaatgtaattccctcgtataattgattcagatctttcaaaaaaatttagaaaaaaatagaaaatttggccaaaatagggtttagatttttttttaatttcattgataattaaaaaacaagagtacatatcttctatttaattataatagtgaggtttgtctttgcataatcgaattcggatttcttttctaattcgaacaagattatatttttcaaaaagtagatatggctcctacatcaattttatctttaattagatattttgttaattcttcctaaataaagaggtacccttgatcaaagtttttttcgaatagaaaaattctaatttgaccaaccgactaactatgttacaccctttaagcgatagtgacacatcatagagcttgaaaaattacttgaatttttttataaaaaaatattacctcaatcaagtattatgtcgataagttatggtctccaaaaatttagtatgttactcgacttttcaaaactgtggatcttatttaactatacctctagtcatcaaagtggtccacataaaatttgatgattctcttaaatcaataaatcatcttctaaactatatgtattggtgttttaaaggaaccaaaatcatatggggcggccactaataaagatcatatggggtgagcttcacaatatgccatgtatcccttaatactaatcttaaagtatgagtctaaaagttaaaagtcaaagactttttctactaacggagtcatcagtcccatgatatataactttttctttctttctcattttcagtacataataatacataatatgaccatatgatacaacatctacttttttgatatataactttttctttctttctcattttcagtacataataatatataatatgaccatataatacatactaaatatataatgaagtgatatatattataaatttttttgatatacacacaccaacaatctaatacacacctacagttaaattgatatatagtttatcgaatttagtttcaccagtatagagtatactgctaattgatacacatctctagataaaataatatataattgttaaaacatagcattcatcaatacatcatatatcagtaaatgatacacgctagatgacttattgatatatactgaaagcctttttgatacacatctagtaacaatttaatacacacttataaataaattgatacatagtttatcgatcttagtatttactaatacatagtatatagtcagttgatacatacctaacaaaatattcatccaacatccaaatacacacctctaggtaaaacaatatatagttttcgtaaatttttagatacaaagatcttaaaaaagaagaagaatttaaaagagaacaaagcatctcgaggtttatattggatcattgttgggtatgtatcaaaaaatcttacagtatatattaataagctatttagtgtgtatcatttgtttatatactatatactgataaatgttatattttgaaaactatgtatcactttatttaaaggtgtttattacaatattggatgaatattttgctacatatgtatcaactagtcatacactgtgtactgtgaatactaagtttgataaaccatgtatcaatttagcgtaggtgtgtatatcaaaaaaacttacagtatgtatcatctgattatatatttagtatgtatcatatggccatatagtgtgtatcgctatgtattgaaaatgaggaagaaagagaatgctttaatcacatgactaataactgcgtcagtgaaaaaattttttgacttttaaactcatactttaagattagtattaaggggcacgtgacacattatgaatcccaccccatatgatcttttatagtgcccgccccatatgacttttattcattttaaagatcttagctcccttctgtgaagttgaagttggttgattgccttaatgaaatggatgaggttttagtgttttacccatcccttctttttgtaaagacaaaaaaaagtgccggtgtctgagacatgaaaatccgcattggctttcctcctaataaagatcatagtgttcctttctttcttcatagatagccagtagtgttctcatcatgggtttagactgtaacttggcagtctatgtgacactaacatatgatgaatatcaccctcgtaagccataacactaggtcgcaagcaagttggagcagattaggtatgatattaattctattggtttttaccttttaggtcaaattagatcaagaataatttgagtgccaactagaaaagttggtaaagcttctcgtggtaacgtaagagatctagatccgatccttcttatctctccaaaatttatctaagttttcactatttctggttctcaaaaaatatataattaattatatattaaatatcatacaaaaaaaataatagttagataacatgtagacattgtcaatgatccattttacacaaaattgattgaaagctacattaaaactatcaacatcaaacttgatgatcaatttcagaaatgttattggtaaatgcaaattagttccttagattcagtaattatctcaatgaaacacatatagtgtatgacttccacgttattacagattctaattgagtcattcaatgacccatatccgattcatctttttcttttggacgtggcccaagcgggattcattgaaaaagaagagtgcaaagtgttagcctaggcttaaaaaaacaaggaaacaggatgcaccagtgatctaaatgtatcctattcatacttcagaagagttgcttttctatggattctggatactttagtttataggacttttcttctaatggacgaatgcaagaaaggttggtggcttttgccattctacgtttagaaggcagtttcaaccatgcgcccacaaattccacatccgatttctttgtttggattataatattatcagttgtcgcgtggaggccactcgccctggggtcaataggctatgcctatgtcatgggaatctcctgcatatggactttgaccaggccaatagctcttctcctttggacctttctatgaaccctagaatatcattatctattgatctctggtttgatggtggatcagcattacatgggttgaaggggctgcaaaggtggaagataccttgacatttgacaaagattgaggtggagacttcttccgagcctagctaagtttttcttatgttgtgtttgatagctggcaatctatccatattgctgataatttaatgtagtaatctgaattactacgtttgatatatttttttggatggtaatccagattatcttaataatttaattgaaaatcggattagcaaaaaaatgaagtttagatcatcctcatccctatgcttcaaggattgtcaactgcactaattggcaccctcttctcagctagatatttttggaaacaacaatcacattataatgaattctttttttttttgtgggaggggggaggggtgctctaccatgttaattttatactttaaagaggtaaactttttgttgtaatttgtagcttaaaaattattaataactacatgattgattgctttaaaagaccttcattttttttgtttaattaatatatccttaacttttggttaataacattacctcagctttaatgacagctcacttcatgtgctacaaaaaatgctaattatactttcgtcctttgagatttttttattgtatgaaatttttagtatgatcagatccgccaccaagctagtagaccaattaaacttgaaagcaacactaccctagctccattttccatcctctttcttcattgttcctatttgactgtgttgctttttgattaaactgatccatcagctccacaatcgatttggtccaatcaataatttctcattatgcttccatgagaagatcttcataaagtccgttttctatatctaatgactaatagtttcaaggcatatttttaacaagctcaagatttctattcctccgtaacttcccatattgttgaacttttgataaaaacttgtaggctcgcaagggcctattaagatgactagtatagtgattgattaccaagtagcagtggacagacataaaccttccaagccaaggacattgaccttttgcttcaaatcaaagggtcataattggttttatatatagctgctggatttgatccggtaattctcaaatcttgatccacgggagcctggactcaaaatatttttgctaagctataaaatccagtacgatgcagttcagttgtaaaaaacctttttctgtagggcaagatttttattcttttttatattcagatcagatctcgtaaaaatattttatatttagattagcattgaccacaaagataataagagtctttttaatttgttggatgcaaatttttacggttgaagatagtaaaaatctatatcttttttgttcataattttttttatttaaaaattttttcacataaatctaatgtttacgttaatttttgttcctccaatttttcttttactgacgtagtgttacaacagatctaatgcaacttgggagtcgagacaagccttacaatttgtttcacccacaggctagctgtcttgcaatttgtcgccaacaaacttttaatttttattggtgaaatagtttagtggactgctcacttcaaggctcaaaccattaaccatgtcatgctagccaatagatttattaaaatatatctaatgtataataatatgctaacatgctacaagacgaataacaaataataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaaccagcggagcagcacaaaggaccttccactttatccttggataaacttgttgaagaatctcctccaagaagatggtggcatcttagaaatttgtaagttggagaaacttctgatttttgaaacttataaatgaaaatgatgaacataaagtagaatgttgatagtttcatactagtgaaaatttgttgctgggctgatgtacttagctggagcattttgatcttttgcatttggataaatagtttatgatgtagataaaacaattaattgagcagaaacttgagtacaaagacaccaaatagatacagctttccctgttttgtgcctaaccaaccaaagtctttgaattgttggcaagaaaataacagattagcataacagcagacctgacacccactggtttagccaataaaactcgctttatcatctgagcttgttcttatgaccagctgctaaaactgctagccctccacaccatgttctctaggcttgttctgaagtcaaccgagcagcttttgtgatgaaatttgtccgcaatctctgtttacttcattttctaatttatctactcaaatgcactgaaaagccccacagattcaagttcgtcataaatatttaatcaaattatcgtagcaatgcacttcggatctcagttcaatgccgtattacagatatagggaataaagcaagagctaatgggacatggctattttgcagtttggaatggctgctgctaaaatgttgctgctgctgctgctcctcatttttatagttagtaagattgtccacaccaggattgaagcaaatgaaatctaccaaaattctggcggcaagctaaccagcaactacttggaaagttagcatttattgtttctgaaataaaacaaaaggaaagcttatgtttgaacttgttatttagatgccaatccaccataaatttattttctcccccagttgacaagaatttttatattacagcaacataacaaactctgttcctaagttaaactaaaatgtcatttttgcttgagttatataatcccattcccttaacatttccttttcaaaaatctacttttccagctacaagttgaaaattcatgaaccaatggctaacagagacaaatcaaccgatcaaccaccccagctttagaaactttatgttgaaaccgaatatccaccaaggcttacataaaaattaaatggcacgaataggattaatttgtaggctatcactcatctttatatacacaccaaaaagtcatgctttcactaagcacccgccaacaataagataggccgaaaagtggtggaggcaagttcttcggtcactactgcatacaaattctgcaaggccagcactgctaaaaaaacaggacaagaaggatggtgaatggcatctagtgatttcggacaacctgaagcttaagaactgacttatcaacagccttctagctttcaatgatgcattctgtaacttgggatgatgagatacccatatcaccaacttgaatatacagtgagaaatggtcagacagatgggtatttgcatcatttgatcattcctactgtgttctggtgatatccagtgggggttctcgtgccatatccagggctcaatccctgactcgaaaataaaccactcccctgtgtccagaatcaagaaaaacattggccaaaaaacaactgctgtacatgaaaatagatcagctcaatcggtgcagagaccaggtgagtaaagaatctctctcatcctctgcaacttccattccatcgccagatctttaacaactgtggccatacttcataaagacatgcacaaaatgaaataggcgatgaaggatgtaagaattcttgctccattgacattagtgcctgcaatgaagataaatgtcaggcaacaggctccaatggaactccagagatgtaaaactccaagttatcaagaaaaactgattatcattcttcaaattaagtgtttttcagaagtcaaataattaaattcactagaactatgtttatgtttgttctttttataaccaaatgactggatacacagacttggtaacttttatgttcaatatgcattacccagactgaccttggcactgttgtttaatcagggatctatagagctgttaatggactggcacatgggcccagttgtttcaggtcatattatgggccatattaaagcctgagctcataaaaaatttcagatttgctcggccaggtgcaacccagtgacagccctagaagctttacttcagtggaacagtgacaatattctcatttgagtatcagaaaatagcttcaactttgctctttgacttcaatctgtgcttccgagatgaaacgaaaaggtcatcatattaaacatcaattcttaatctccacctttccaggtataagaaaatattggaggattgctcgccagtagcatgagtacctggaaggaagatcttcttgacagcctactagcctcccaaggttcatggcaggcctctttcttgtccataaccatctttctcaagtattcagcagtattcataaagaactaaccttactaaacaaaatcttctaactatttcccccaaccacttcagaacctttgcagaacatttcactcctgcagatccctctccagcaccaaattcctaggtgcttccatgacctagacataagagctcaacttacttattaccacatccgaatccgctccattgcatattttgatgtaggtcactaacaggatagacaacccataacaacctcttaacctggacgaatcatactaatccgaaaggctgagatcccatatggatcatataaaggtcgcaggaggttacaatatattcagagaactagcctaatgcagaagtctcatgttgaaaaatcatgtatcatacatgggtaacaaatgttattatattggataacgggacaaagcaagtttaaaattttattacaaaatatgacaacattgcagtgaactgcaaagccttaccagctaacacacaatgtgagctactgcatgaaacctagagcacactaagtcgaaatgcaatatggttataaaaatttaacagagactaaagatgacccaaaacagtggacattgacttgatgagaaactaacgtaaacatgctaaaacaggaagcagtataaattacagccaaaagaagacataccgaagcttccagaagcaggtagtggcaatgcaggcaatgacatttctgcaacatgaaaaagatcacaataacattattatattggcaatgatatctatatatataaatatcaaatgcaaagacaattttgtctagagtagattaatatgaaattttgtctagaatatattaatatggtttgtcaactaccattaaatataacattcctttacggtaatgctaaccaaagacaacaatcacaagagaacctactcaatctattgatgattagcagggcctgacaagtaccagcctaacaagcaggactaatgaaaccctggccaatggaaaagagttacatcctaggaaaatgtgattatggagtccgataagcgttttcatgccgtaattcccaggaagccaagagctattataaccttaaattatgaagctttgcccctaaattctaaattactaacaacataaagtacccatacaacttcactcacccggggcacaaagggacaaggattgaagagaagatgatgaaggccatggtgcagcaatattgtcactcaaatcacatgtaaaactaaaacctgtaacattgtcaaatataatatctgttggcaagctccgaagcagacagcctgcatcgatagtaacatgtttgcatcaagcaaatatgtagatcagctactagcagattgatttaaataaacaggattgaagtttaacaaaccttgttgcccatatgctgtcccagttgcagaaacagatccagaggaaagataagttattagcccttttgcaatactaaaggaaatcaagtgctgtgtgaacttggaatcaaataaaatgaagtgctaagcatgtatttggaatagaaaaagtatagcaaatctaccttgaagactaaaatctttcaagtcgacattgcaaagctcgtatatatcctgttgtaacgccgcctttctgtagcatggacccaaacaaagtagcacagttgatggcttgcttatttgttattagcatttgcctttgtaatgttgcaacataagcatttaatgtattacagcaggaaggattcggagaagctaaatcatggcatgcattgattacatccgagggctctttgaatttcaacggacaaactacaagagaacagacaaaaataagtagtgatttgtgtaccatcaagtatttgtgccacttgaagcacacaacgtaccatatgacgattctgagcatatgagtcataacgtcatgttttctaaaacatcataaatattatcaggggaaaaaaaagaaccagcaacatcatattaagctaagccttagctgcagtaaaaaggaataagatggtccctgctacatcctttctttcccccaaaattctttccctaatcaattaccagaataggaggcaaaaaatggcatttctgcatcccttcaatggtataagaagcggactcagcaacaagagtcaaagtgctgtatgatcatataaagggcatgattcaggacatcttcatgatgttaagaatggagactgttggtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaggatccaaaaaatcaatgtccataaaaattgttaaatgaacatagagcaaaaattcttctacatcaacgatctaatggtggtgcaacctggaaagatcaaacagagaatactgaaagataaatgatcacttgctgctcatgatcaaagatcagcaagttcagcctattgatgatccacaactgaagcaccaagtaccaagtctcgctgtcaattaatccttcagcagagcaaccaaaggattcaactataccaactagttaatgatcatgatcaagatactatgatggtctattccttgccagttttcagatccatcactataccccatcctaggggtaatgaaatcccatgtgattattaatcattacgcaccagaacaaccatttgacaatttaccatgagaaagttatttgctgatctctgtcttaagcattggagataaggaattcgtacaacaaccaagggatcttaaaaataagatgcatgcagcaaaaaatttaatgcaattttgggttggactaggtcttggtttaactatttcaatattttagatatttatttttgtttgttgattataagttactaggaatcaatatcttagtcctacaattattgctatttttaagttaaactctcccatcagttcaatggatgtggcataaatttttattatttctcttgtaacttttactgaatttaatagcaattttctgggtgattttttgtcatttcaagtgtaagaaatgagtcaaaagactataactctattgcattgattaggctaggaaagtgctaaattattgaataaatctaaaaaacttgttctcagaaaactctaaagaaagccaaatataaattttagacctagattcattaacagaaaaacaaatcagaatctttcaatagatttaggcagactattttatttccatattacttccacagtttttacagcattattgctctattcatcaattagaatatgtttgtggctttatatccgatttagcattaccaacttctaaatttaaaatcaattctcattcaaataagttaagaactatgtatttctttgtagatttaagatgcatctattttgctgatgacaccaaacatagcagacgtaattcggtcagcaactctgcgcttgtttcagcattgttaggactggcataattctcctaattggaatggacacacaggattttatatatttttgattcaccacagtaacctctttcattgatggtattcaacattttaatagattttgcaagggaaactagttttatcctatcccacgaagccatctcctccacttgcatatgtaataagatttactttgtcaactgggaaaatgccatgaacaacatatacaccttaaatatttggcaattcaattcttctagtaacatattatttacttatgggcacctgaatcccactatgagctagatactgcaatctagttctgtttctgtatatttttattttctgccttaactattttttatcaaagcatgagcacaaacgactgatgagcactttgaacggatgcttgagtatgccttatctttttgactattttgttgtagttcaagcatgatgggatgggtttcaaaatgagtctcaacagaacaagagttccatgcaacattgtggatttaagtttcataacatcataacattccaataaaactgaacaaatgaaaatgaatttgtaaaatttaaccttttgcatcattttcaccttaatgttcaagacaagactttaaaaaggcaacaaaaaaaaggtatgagccattattgagttacaaatgagccacaaatcaaacagatctgtaggaattaaagcttgctgacttgcatggaccatggcatcttaatttcaggaacatgagctcctgatcgccagcaagaaaaaggtctataagcttcatgcatcagctcagataaaggaaccaaggaaaagaatgaaaggaggagacgagatggaactcaagtcttatttcctgctcaatgttattgaccactgtttggttaagattataagaaaggcaaaaaccagccctttctatatatttaatgcaagagatgagacattaatagccccaagacacagcttcttcttccaataatattaaggtttagccgaaaccaaatagctacctaccttctccatgttatcctaattattcaaaagcttatttgattgccagccctctaaatggctccatcactctcccaaacattagacccaactcttgatctgcaatctttcaccttctgctcaagagaccttaacaagtagtccccaacaggtcgtatagaacagagctacagttggtagctaagcattatattgtggcaatgaaggaatagcagactatggactttaccatccagtgagggtcctacagaagataaaacaattacagggtcattacaatgtgatgtataaatgtgtgtctccatacatgcgtataccaatggttttctcaatttcacaagctttttttaatcctgtcatttttttgcactgtcatcgctctctgcaacattccaaaacattataatctatgtgcaaaaagtatgcagattatgtattgatatcttatggtaaagaacaaacatatttgcagagatgacaaaaaggttactatcattagcaacaaacatagcatatagacttcttacaaataaattaggcaacttacctttgttaaccttacagctagataacatccgaaatgcactgttagcagcctcaggcaaaagcttcctggaaagccatgcataaactactgtcttacagtcatttataacatcaaccccaacaacagccccagaaatattagaactgtccgcaacactagctcctcctgatgatatgtgaagtgcagcttccatgattgcaggctgacaactaggcctacagcactccttaagtgggtcaatagtactgcaggcatctagtaatttgcttgtgtttactgctttctcaaaggatttagcatccgttacaggacaagaaccaccagtgagatttgaagacttcaccgagcacagggtagggatagtgctgtttgcccctctgctgactaaaatacttataatatctgaaaaacaatcatttgcagcagcttgatgaagaactaatgcattagatacattgttgtaggcacccagaaaaatgtgcattaaactattaacctgaggacaacaaattgcatttccaataagtgcagccaaaggttcagcacaatcagatgccgtcctgtctataatacttgaaatagaagaaaaattcacagggcatctcccagtcaagactggttcatatgtgtctggaaatgaagggtacattggtgattgtggttcaacaggatatgggttaggtggaaccacagcaggtgaaatttctatgggatcaaagagtccactaggtgggtcagacagaataaatttgtcgggaacatgagacttgggttgaaaagttgttttctgcggcactacatcttgcaaaccacatatccagattgtaaatattaacaagcgataatacgaaggccctgcaacaatataagtcttttctcagcaccaaaatctgagagttacatatagaggaaaacaaatggcatctagcttgcacagcgtcatttgcataaaaaactaaagaagttgaattttgctgcagtcacctcatgtcaccatttatttttactcttgcacatgcagtgatacaacactacacaaaacatgtttaatgtaatgcagtatcatgcttacaagttgagcctatagcatgaatggatgcaactctactctaccatgcctaacatcaatatgcacgcctccatatgtatatgacagactatacctgttaacaaagttgtaagcttgaattttaaaagagaaagttacaatagaaccatccaaattttagtgtggaaataggaaatctttgtaagtctatgtggttgctgagaaagtgaaagaaaagaaagttatgaaaaagacaggcagaagtttctctcaattaagccaattattttcttctcaaataggaagtaattttgagaaagaatgacaaatgaggcaagtggctacagataattcaattccatacaacttctttccatttctacccagtcaatcaaacataagaaaaacatcaactttcttttcttttctccactgagtcgcttttcttttgttcattttctcagaagccgacagaggattaagggtacgataccattatccatattccctttttaatgatatgaatggatcttatattttattgcatatattgtgaaaacttgattggacatcaatagaaacacttgttactttgaatggaatgctcattttgtttcttggaggcctaaatattttcatccatggatgtacgcttgaacatatttatgcatgcatatttgtagctttatatgctgcacagatataagaaaatatattacatgaactcaggtattcgcatgcctaaggcacatgtagttgttagcatcaacatgtttcccaggcacatgccttacttttcttagatgctatggagtctgtgtttcccaaatacctttgtttttatgcatctttgatttcctgaatattatgcttatacacaactatgcatttttcctaggacaacagttttttgcatttcccaagtggatccaaattttctaagctatgtactagtgtaaccatattgatggaaatgccatagtacactcatcttattgcacgcacgcacgtaaaaaattttaaatcccatagggtggggctatccgatttgcccatggaacaggatgtgccaccatctcagcccatcctaatgctcaggacatgagatatcccaagacatgccgattgggacgttgggacaatgacgagacgatcctgtctcgacacttggaatggcacccgattagttgccgaataagatttattttttaaaaaaaaagcattattgaataaaattgacaaacaaaaaaaattcaaaaactccagacactcatttttggcatttttgtatataactcccaccccccattttagattaattgcacataacaacccctttttaacaattgacatacttgcaaattgagatttcccttatctcaataattacccaacacgatcgcaagctaaatttcagtaagcaataaacatcctcacaaagactaacatccaaaaagtaacagataaaattaccctcattttctctatagccatatgcagccctaccagccacagttataagtcaacgatcccatgtctcaggactctcctcactcacactcagtcatttggagcttgcagttactgatctacatgtactcatggatgagatccctgcaggttgcagctcctccctagtgccataattagggttaaaatctcaattcttgttatcagcaccgttggagtcagcttctagccaccaagaaacattgggtctcaagctcctagtgaacatcattattggaattgagctctttgatgcaaccttaactagaccatggttttaatttactcctcataagaaaaactcatcaatcaccatgacaaaacccaggaaataagacctgttgaaaattttctaaaagaaaggtaaaaatcaatctcattatgattcaaacacctgataattagccgacaaatattaattattatgagaccggcatataagaagtctaaaatatttcctttattctcatggatctggtgagaatctcgtcaagttatcccaggcaaaaaaggatgactcatttggaaacacaaagcagatatggaagactgatccaagtaccgctaaaaccagatcattcgagtagagtaagctgtctgaatttaaaatgtataatgatgtaacaaattgtagagataaaagcatgacaaaaatgacaaggaaccccggaaactaaatatattaacatagccttgggcagtttaaagaatttggcagaataatctcagtttatgataaaacctaacaccacaaagcactagagtcacagaccgattgtaagtttccgaccactcaccctgaaaaaaggtggcaactttgagatgctccatacgggcaatatcccctcaacccataaatgattcaagcctaccgcttcgcaatttagagctccagcactgtgaaatattcagttaaaaaatttaaaaattcgagcacaaggatttcatcatatcaaatcgacagttagcagcgagattggtactgaaaaatacaaaaatcagcacaatgtagttatcaaagatagataaataaataacataaacataaacatattgataaaacaacgagttcaagaaaacaaatagtaataaaaaagagatggattatcagaatattgatgcttgtttttgtagcatggattgttggatattttaggaccaatttggtggtcgtgagaacaaaaatcggtgagagaaaaaaaaaatgttacctcttgttttgtttctttccctattttatagatcgagctccctcgtgaatggacttcgattcggaatcggttctctctctatcttgcttcctggtttcttctgtcccaaatgtcgctctcggggactcgccctcttcttctgctgttctcaacctttttaattttttatttttttttatttttttatattctttttttgcttttcctgcaccggctttctgagctgctttccttttgctgtgctttaaaacaaacaacacctgcggactccacaccgcaatttatttcggttctttccgattgtcccctctgagttaccgaaatgcccctcccccccccaggcacgtgtaatgcgcgtgccgcctcactatggaacgaactttgacctgacttgcagagaacatggagcaaagacaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaactagattttataaaatataaaatgtagtattgaataaggactcagcatgctatatcataatattattagacaaggtttttttttacctatattttgatatttgttagcaaaaataaattttattatgtgaaagtgagatttataaatatttatttattttataatttcaaaaatttaatatcaaataatattaaaaatgaataaatttttttatttgcatacattatatatttttattattttagaataaattgattcatgatctttttatttacacaataatttaagtgtagtatgaatatccatatgatttataaagtaatatgcaaaacaataaaattttgatctttaaaactagtcagccatgtccttgaaattgcaccaacaaggaccacatctatccagaaaggcaacaagctctttctctttcaaccaaaaatcattaaatgagttttttcctttgtaatcatagaattactcttttttacccatccctgccttcatttaccgttgcaatcgcccattgagggagagagagagagagagtaattaacagagaacaaagaaaaatctccattccatctctcgtaacaccaaaatttcaccaatcatataatcagacggaccacatcaaacgcccttttctgcgcatactcgacccatctggtcgactcgcactggatttctccagcgagcaaaagaggggaagaaataggggagcagcagcagctgaaagagtttcactgtcgcaccacagaggcgaagacgacgacgaaaccatgaagagcagcagagacgaagaagggaagaaggagatgagcagcggaagctccagcccaaatctcgaatggcgattcaaccaaaccctcaggaacgtccaagggttcgtccgttcgatttcccgtttttctccatttcaagatttgatctcttttgctttctatagatgtcaggagacctccccataactaaattcggatcttgaaaacgaatgctattgatattcccttcggttttaggtcagatcggaatgtgttgatgggttttgttagctttgcgttcctgcgatcggagattgcataaagttgggatcttgatagattttgatggaaaattcggagaatttgtctagtttttgtgccacaacgaattatttagtgtctactgaaatgaattcactatcagatctgccgatttatgtcagcttaggattgctttcatgttgttcacttcacgtgttctgatggaatctaggactgacactgtctggttgggtagttgtgtgtgttttcctatttattgctggtttgttgtgttattgtttatctgtaaaggatcgtcaagttctgccttgccgttggggatttcagtgtttgtctaaattcgtagttagggactttacgcagctgttgtgggtttcttcatctaataactgaagctatgttaatctttcatgcgagaaagaaaaaagaaggaaaaaaaaaagaagataacgatttcatcatgtaactggaaaggctgtatgtctgatctggagagcttgaatttccttttctgtggttgaattctattacgagataaaatggatgctgctatattcatctactagaaaaaattagtagtggttgtgtttgatttttatgtgactccaccatacatacttataaatttgacgtccagtttttcaccttcacacaataattggactgctcaggctacaattctctttccccttaaactatcttttagtcatgcatgcagagagacttaagtatcgatagtaattccttggttagttttcttgatgcttgatgtattatgcctcgtctagccagtttattgatatattagaacacaaaataccactttttgacactgaatcaggcaaaaaaaaaaaaaagaatcctcactcctgtcataaattggtaattttgctagttattacattaatgaaactagagttcttctccccctttttttgggcattacaacctcttagtgggcattatggacttcagtttggaatcctttgttcatttggactaagaatatttataatatttcctttttgtccaggatacttaaaggccgcagttttcctggtaaggttttgctaacacgcagatctcagccaatgaatgaatgtgcctctcctgaacactctcaaggcattgaaagaagatactctgaaactgatcgtgagcaaggtgaacatgctgacaggtcttttgaggtaataatgactctatctacatgtatttacttttaaatggatgcagcactcggatatcttgatatatcaatgacatcacaacacagggagaagttcagaattcaggcagcacaactaataataccactcctcaaaactctagtacatcaccatcaaacaatgcaagtacatccccagagctccagagatctgtttctgcggctagagctacagattctgcaagacttaccaaattcagaaaggaattgtctagaccagctgtcatattaggtatattttattgcttctgacttgttggcgttgcttccagatgatggtagcagaataaatcaaattgagcaaatcacatcctagttaggttttctgattttccaataaatgacatttgtctcattatttgatttggttaggctctttctatgcctttttcatggaagatcctcttttattcttgatatgtagttaagatcccgtttttattcttgatgtatagttaactttggaaagaaaaatggtactgccctattaacgactaaatcgcagctgcggaaatgacttaatttatcatggatattatatgtatctctatatctttagatatgcctgatgctagcagtcccagctgttcacaaataatgagctaaacataatggatgcacaaatgaaaaatatcaggttatatcgtttagcttcatttataacctgaaggtgttggatgtgctttcaaactgactcatggtacatacatgatgcacaaaaattgtaaattatatgataagcaagcaaatttgacacattatggaaaggagcattgcagaaaaaggatgacgccagctagttctcctatatagttaaattgtagttttaactggggacactgcttaatcatatgtaaattacccgatggagattccacgaccattcttttcttgagaaattatcatgtatagaattttgatcaaaaggttccccacctttgcttttggagggggcttaacatagaggaagttgtgacaaagagtatgagacaataccaaatgaccaagatgaagcatgatgactatggttattttatgattcactaaataaacaatgaccacttattatttataatacagaggctgtcccagtgcacaaggctccctgactacagggtcaagagaggcaaatgtaaataaagaggctgtttccatgtttcaaaccataacacctaagtcacaatggagcaaccttaccattccaccaagacctttcctcttaacttttttatgagctatgaatcccaaaattatctaaattgcccctaattccaaaacatcaagctagatggtcgaacatcaacatctcaaccattgaatttttcaacactagcccacaacctcgtggtgtctaagttccatattgttctgtctttctctctatctcattttgatcatctagaacatccttttatgcatcccatggtgaatatctgtatcttatttattccttacaataaatttggatctatatcagtttaatttgtctcataaaaaatagttttccttttaaattaatctttgtaactgtttgccctatgatcgaatttgtttggagcatctgacacttaagaaacacaatcatccttttgtttaacttcatcaatgttctactcaatggcaatattaaaacttatcatttaagctattttccatgggttgggcattgaatataaagacgtgatggtatgatcacatcccgcacttaccccctattcctcctacagtacattaggtgggagttgctcatttatgtagcaagtataaccattgtaactttttgacccttgaatgcttctattgttcctaattttttggtattctaatgtcttctgttgtggattggtatttgcattcgcttagtttagtgatattttttttcttttaaaagtacaaactagtacctgtactttttagaactgaataagcttttatttatatccttacattgtctatgtggcagagaaattacgcgaactatcttggagtggtgtaccgccatatatgcggcctgatgtatggaggctactgttggtaagtgaccttccatgattgtgcaaattcattgtactacttatgcaatatttatggagcaaaacacaaaaaatgctattctcttctaggacactaacttcaacaacctacttgtgctatgcattgacaatatgaaattactacagatgtgtttcgattaacaatgatatttgacttactcttagagggaacactatcatgaatttctgtttctttcactataaaagcacaaggtaaaggtatacatctttcatggtgaccagtttttgtgactcctattgagaagtagtcatgactggcggtatggattaggcctgactggagcctatattttttttatttctgacctatgactgtgatcctcagacctggaatgttattgcccttttgtcttagcagccaggcaatgaggttttcaagcaaacattgcatttgaatcaccttttgcaaattgattgatctgcctatatatgcctatatgcattgatgtttggggctaactcaactccccaagtgagtctgctgctgctgtgcagaaaacttgccaagttgaacccttaaccagattttggacttgtgattctacttcaggattactcatgttcagattttgttctttcacattatttttttttcctagtaactggttttgtcaaactgaagtttactctcaaaatcctagaatgaagaacaaatttatccatccgttgtttggtttggctttaccatcgagttcatctattcttaaggcaaaattcacttgaaggacctcagaattttaataatatatggtaacgtgttcatcaatctgattgagatttgttcttgtttgcaacatctgagttgagagttccctctttgctccagtcctatttctcccttcagaaaaaggtcccacagttttgttgttgtagtccttagttttaatcttgttgaaaagcaaaaataaggcactcagacatgataataatattatcatttattgttagcacaatagaaaaaaggctgacacgaacaagcaccgatagatattttagtgtaaacatgctcatgtcatgttttgaccctgctcatgacacatgtttcatatattattcgtgttctgcttcctggtttatgttcttatatttcaataaaaggcattcctactcaaactttttttgtgttataaagaacttcaatattaggcattagacacatacatgcaaatccattgttttgtgggagaaaaggctttgcatctgagcctgacctttcatctgcttgatctaatggttaggcttcttctaagtacgaagccacaatagaacaagtgccatctctgcgaatatttgccaatctaacatccatgctaattcaatccacagaagcaaaagttgtgcattacctatttctcaacaattcttttggggtgcatagggtaaccaagcggtcccataaatgaaccaccattcttgtccattattagggatatgacttttctctagtttctgaatagatcagagcatggactcaagatccaagctcggtactgggtactgtaccagtaggttactggttcggtacagtacatgaagaattatagatcacaataatcaaaatagaataataataatagtccagggtggatgtatgaaactttattcactaatttttctccgacaagggcatggttttttttgttttttaggttactttaggcattcaaaaacttaactatggctggaaaatcccatatgttgcctcttctcagacaaccatgtataaaattgatgtcaatgagagctgttctaccttgtctgaagcagcataaagaataaaaactacgattttgactaaagctttgcaactagagcttgggcatattgataacccattcttgttggcaattagtatgctgtttcatcttttgctgatggatcagcaataaggcaaaaactgtatctgagaaggaaaacaaacaaggagatattgaaatgaacatttggagtaagtttataccttcttgggaaacttggccaaccaaacctggagtgagtgaggcgcattccatgtagttggcaggagactggtgagaccaaaactctccctccctctcactaacaaactcaaacaaacacttctatccatgccttctttgaattgtgctgtctacttggagagaaaagcatcaactagaacatgttccttttttttatttggcactgaggagaattccaagatttggactaatcaactcctcttaaaacatagcatgagcttcttcttttttttatctttttgtttattaacaaactcgcaatgggcatactggtttgattttttattggttctaagaaaatcaagctaccttttgattcccacccattgaacattcacagatttagttcgctgtcccagtactagatcctgtaatggtaccatactattgcagtattagtacgcggtatggtatgagacagcatatcgactgtcggtatgatatgagacagcaatatcaggtgatatgaggtgggacggtaaaccatggatataattatgaacataccatgcggttattgaagccccttcagcttttctttgcctttatccttggatttctgctctacttaaatggtcttactagatgcttgtaccagaaactacatttttatttataaaaatccttctccatgcacttgtgtatattgaatgttctgttgcataattgaaatttaaatatcagctgacaacagggatatgcgccacctagttcagatcgacgcgagggagttttgaccaggaaacgacttgagtatgtcgattgtgtttctcagtactatgacattccagacacagaacgttcggatgatgagatcagcatgcttcgccaggtttcttttgagcttctcatattgttttttgatttctccatcaaatgcatttagaaggttttctgactcttcatcatgctattccttctttggtgatcagattgctgttgattgcccaagaactgtacctgatgtccctttcttccagcatgaacaaattcagaagtccttggagcgcattctctacacatggttagatttctagtcttactgtaccatttaggcaagggggtttgtgactgcaaataaatttctaatggcactatgttttaagtgtttgggccaaggttttaggcaccatgtgttggtgctgcactgtgctagtgcttggcacacactggcaccaatgggtcttgcggtgttccaagcattgttgtgcagctgcaccacatgccactctcactggcatgctatgagctgagcagcacagacacgcaggggtggcaaatcatggtttgaaccttacttttggataccctttgtaatatatttctattgccccccgtgtatttgttacatgatggacaaatccagtgttcgattgaactgtttggataactaagaaaggaaacatctatacttaaatataaataatatttgggtatgttctatttttgctctgaaaattcttatgcttaaacatgttaatatggtcagaaggtgaaacatgacttgttttcagaaagatgtaagctgtcattatgaatgatgcagcctgatttttctttttcctcagggctattcgtcatccagcaagcggatatgtgcagggtataaatgatcttgtcacaccatttctgatagtgttcttgtcagaacatctagatggtggcatggagagttggtcgatttccgaactttctcctcagaaaatctctgaggttgaagctgactgctattggtgtctttcaaaactgcttgatggtatgcaagatcattatacatttgctcaaccaggaattcagcgccttgttttcaaactgaaagagctagtacggcgaatagatggtaccttcatcttcatttgaagtctttttactccttttgtcttgtgtttgccattattttcttgccatatgtctatcgcacttaatcatcttgtgtctgtgtatatcccttgctgcatctgtctcaattccatcatagatgaaagtacaaagatcagtcctgtgcttttactttgggggttatcatttcataatcaaaattttctaatttatatgatctcacaaggaattaatctcactaatttttggctgccttaacatcataagcaatggaattatccttgacaaaaaatattattgtaacatttgattactttcaatccaattatactcaaaaaacattctagaatctagaagagttctctaagctgatgttcaaggggatgtttccctcttctgcaaaccacaatcggttggctgtagttagcttgcttgcattttcattaccaataactgttctatagctttagttttataagttcagaatcctaatggtttaactttcatatcttgttctaatataagaacctgtatcaagacgcatggaggagcaagggctggaatttcttcagtttgcttttcgttggttcaattgtcttctgatacgtgaggttggctttctgtttcatattattgtttaagataatgtttttgtaataataagtagctttttttttttttgggactttgtagatccctttccatctggttacacgtctatgggatacttatcttgctgaaggagatgcattgccagagtttcttgtgtacatatctgctagttttctgttaacagtaagtatgtgtttcctcacttgagagcttcaagtctcatggaccaacattagtaaattttgaagatacaaatttgatgcatcgataagtagctatgtttgcattccattttcctatttttgaaccagccagctggtacaactaaaatgaaacagaaatcagattacagatttaagtgacacaccatgcctgcaatacgcctttttctttgattcctacattgtttttcctaccaccatgcttgtaattttgattgtctactgaactggctaagcagtaaccctctggatatacactacaggactttatatgctactgcttccaaatgagattcaacagccaacgattttctttcagtaggtttcgcaaatcatctggcaattaacaatacattgagcatccatctctaccaggattttcctctttgaatactgcatagctgtcatttaaccatctctgacagttgtcaactctgcactatgagtttccttatagcccacaaactataaaatgtggaatccaatctcatcccttaaaatctccatcctgattttgtcatctagagtataattagatgcatttatgtttgattttaaccaacctgtcggtatctttatcattttggatgcttccttcacttggacacaacatatgtagcattaggaaaggttttaaatcccgtaggacggggatgtcctgattttttcatggaatgggatgcgccgtcgtctcgcctcatcccgatacttaggataggggatgtcccaagacatctcaatcgggacaccgagacactagtgggacagccatgtcccagcacatgggatggtaccttgtcccggtgtcccgtggaacatcttgctgagatctgaattattgacaataggtgatccctatgtgacataatccttgcagctagggttgttgctcttctaccatgctttcagtgaccgtttccagatctcccatggccgattttatactgtatctttcagccatgccactgacatcctcctcctcctccacctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctctctctctctctctctctctctctctctatatatatatatatatatatataatgtatttaattatagcataaaataaaataatagcaggcaaaaacatgtaaacatcgtcaaaaacatattctgcataagaattgcctaacaaccacatctagccatttttggaccagttcgcatttggattgaaaatctagcgataaaaatccaactgatatttcaaatatgtttttgaatctaaacttatccaaacttgcagtcccagggatggctaacgtcctaagtcaacaaagctgcaatgaatgaatgaataagcacagataaataaataaagtgccacaatttttgaaacaaataaacaaaatcggacctcaattacactaattttctatttctttttaaaattatcatgggtgtcggaaaaattgcagaaaaaagaaagaaaggtatacccgtggtgctggtaagcttcaaaggtaacaattcataaaaacactgaaaattaaatcccaagtagaccgttagcatctactggatatcttagtaaacatcccagcaaggtggcgataattcaatatgtaaacgcatccctacaggatgtttccggccaaaaggcagttcgtctccatgtccctctgagacacacctgagccaacgcgaacaaaacttcccaaagttccatcaacgaaaaaatcatttgtcatcttatagcgcacctctacgtacatttgctgctttcctgtttaaatcattaggacaactcatacacaagaagattgaagagagaaaaaaatttgaaaattatagtgcagtcacatcatcaaactccatgaccagtacgcgcaaatcttcctttccttggcatgattcggttgcatggaatcccaagttacatagagctatgatcatctataagacatcttccagaaaatagcactacaagttacttgctttaagttctagtaacatgaaacacccataggaaggcaatcccttctggagtgggttgtccctaaatttttgaatttgccgccattgttccaaaagtttagccttctaaccatgtcaaagttcccacgatcaaaaatttgcttgggagttcacctgggcatggtgcgagatatgtgatcttcttcctgtcacagattcaaagttagaaaatgctgactaaagggtcattacatgccaccatatcaagcagtcgataatacctttggatatctatgtctgtgacatagacaaaccctgcgacattgctgcaataagttaaaaggaaaagttagacgatattagctgaagtaaagctcatgaaaaacgaaagaaaataacactaccatgttgccaccaacacagacaaaaattgcacacctccccccaggaacccattagttaattttaaaaatttagcagttacaggagagttaattgcaaggtagctcaaggcatgaaaaaccagctctgaaccagcaaatcgtgactcttggatttgccatgcagcccattctcactagacttttctagcatcgagatagatggcattttcttgaattatcaacccaaaattttacttacgcccacagagaaaccagtagagatctagaggaagagtagactttccgttttctggcatattttttttccaaccaataccaaggattatatcagtataattgagaagaagtggatttttaatttatgctgctaaaatttatgaccatttgaaagttcacatggttaactttttgcatctaaaagtttggtatctaggttccttatttccaaccgtataacccagatgcaccaagatcctttaggtccccagatccaataaggcctggcaaaagccatgcaaaatgagaaggcacggtgacagataattgctgataggaatcagctaaccaaaaatatttacctggagatgatttgatcaggttcctttgcatatgaaacagccagaactagatggagtaagtcacggcttatattaacagcaaccagccgggtagggtctgccacaggctctgcacctataggcagtgctgatcggggtgcctgtggaccaccaccaatacggtagacagaaatatcactgaaattcacaatatttgaatgtggagacaaatcgtttgcaagcccgtaaaagtactcctgcaaagaaacccatttagagtgctgaaacattataaagcttccaggaataactaaaattgataagtacacaagatgagatcattataatgttcctcactaatcaccaacacaaaaagaaagttcatcaccccagttacaatatagacacctccaaaacattaagtgtaacttgaactacctaaactagcatcaaaactaagaacaacctgttttccttccaatgcaagctttctggaccaacataaagtaatgactccaagatggaatgaaacaacattatttataagatttatgtcatcaacatttgtcaactttttgaattaaggtaccaagttcagatcattttttgtttggctcccgacaattaataattaatgaatgggtaccagactctttgtcgaggcaacacctggcaaggtaggggcacaacaaaaagacctgcaacgccgttaggcaggtcagcagacctgtttccataattatacagtttaactcactcttatggagatgaaccttccaaggttcctccatacttggataatatggacaaaaaagggataaagacaacgtctaatgtagggagtttatctatctttaagaaacatatcaaaaagaaattgttaaagaaaccaagtggactgggaaataaaccaaaaattaagattagccaaaatccagtgcgttgacaagccatcattacagcatgacatagatgtgttaggcaaaagacatcttagtttatctcacatcacaatttaaaaataaattaaaagaaaaccagatttacaaaagaaatcaggaataacatgagcagggtaggaatcgtctgaaaaggttgataaaataacatattatgattagtaattcattttttttttaaaaaaatagttgaagaatccaacagcattcactaaggtaataattcataaacaagttaaatcataatcttatttttcaaagatagtgcaccattacaacaagaattttgatacttgaaccctatgtttttctcaccaagaaaaggaaccctgatagcatgtaaacaactacctagcttacgatgtaagaaaatctaaatgcataccttgtttcccttacctgccaaaacgtgtcaagaatacaatatatcttaatatgtaaaagccagcctgcttataaaaaatgtaaggtgtgattggttctatttccatgaatacaagcatatcaacccatctatcatgttagccaagcatactgatgtagataacatgcaggagaggcaaacaagcatatatttcatatagttttcagagtacataaaaaagaatataaagaaataccaaggtaaattattacaaaggtgatgtctctcaacttaccctgattctaaagcttcttgccttctggcggaccttagtattcctcaggacaacaccacctgacttatgtagtttcacaacatcaacattaggcttgctctttagtacctctttcagcatgctgcaaagtttctcctggacaagatgcaccaagaaaatgaacaaaaggaatctgaagaaggtccttagtggataatgcactctaaatcagtcagccaaaattttctgaaattcaaaatattaaagcatttcaaatgctgggatacgggtaggttaccctactactctaccaaacagtgctacttttgggggagtaaagacagcctggttgacaccatttttaaccctcgattcctggctaatttcttctctctcttctcatttcccactttttcagttaacctcaccatttctcaaccagacagcaactttttcttaacccagggatatgaaaatcttgagatttgctgagggttgagcatatctatcctggggttttcaggttttctatcccacaaccaaacacagcctaaagagtgcaactaatgcatgtgtaaattttctaaataattcagaatgcgggagtttcctaggccagcatgtgcacatctgtagctggtgcatttcacgcattcacatgatgtctgccagaaatacttttagttagttttatgctccaacctgaactcttactagaacagagacaagtttaacagacaaacaaacaaataggttatattaagataaagatttaataaatcacaaacactgtaatcagaagatggaattcttgtgcgcatatatcatatagttctgttatttagctcaaccattaagcaaaagtcagaatcagaacacattgatgaatcaaaaagcttactcaaaaccaaaagtggcagagggaaccatgccctttaaatcagaagttattcatgcatacaaaagcttctctactacaatgtcaagtttattttcatacaaagaaaattacctgtcccaagaccagaaccacattagcattgaaggtttcaattgcatgtagaagcaactgcagatcaaaactaaacagatgaatgaatatgttgcagcttaatgtataggaaaatattatcataccagtgagagaaatcatgatacgaactaacaaaagaatacctcatatccaagaccttctacccatcccatggtgttaatcaccatgcctgcagctctagattcagcatttccagaaaactgtctttccagagttcgtgctagctccttcacaagcactttgtacaactcggcattcacactgttgagcaacatattcacaaatgctataattatagaagtgcaggcaaataggctagtattaggacacaaagtggcatcaatctaaaagacctatgtatcataaaatattgattaataagctggtaataaggcaagagaacctactttggagtggtgtgcccataaaaatacacaataggcatttccagaggaattccttccactgcatctataggcatctcaatgggcgtagcagcgatacatccaggaattgttatagacccttgaccaatatccaaatccacaaatgtaggtttccaaccctgtttacaaccccagcttagaagcatcctgcacaagctactctttccagaatccataggtccaacaacaatcactcgaggaccctgaaataatgagaaagtaaatgcttgaacttcaaatgtaaagttcatcagagaacagcagtaagaaagaaaaatgattaacgactacaaactccacaaagaatgctttcaactcctacaaagttttgaatggcaagataccttatgctacctctcactcaacaagtagcactaaagtaattattatgcacaaacaaatataatcttttaacatgtttcagtaacatctagataaggtagcccatctcaatcaaggactccaactatgataagcatctgaaacaagctattacatcctatatactgcccctaacttgacatcctaatgatatatgtcactagtatgaaccattcaaattgatgaaaaattgacaagcttacttcttcattttccacatatcttttaacaagagatagtatacatctttttccatatacctaataattaaatgaacatttctctttccttgtacacagtctttatattctttcctgctcattactctgttatatttctttactcttcactgcaatatccactctttgccaaaatctcttacaagttgtcaacatttcttaacctgctaaactaatgttaaatcccatatctgtgagacttgttatgacaacaatcgaaccccatagtctacagtctatatgttcatcattctacataaatattctgtatcgttcaaaggtgtatttttccagaagcagccttccccgcaaacaaccacaactgcgaatgtggtcattgcttaactcacagccaacaccatcagttgcaaaactgaaagaaattgagtaaccattgagggttagaagtacataaatagcttaatacctgggaagaatctttgtcgctgccttgggatgttttagcacgaatccttcgtccatcaagaatagcatggacattcacataactcaccataggcgtctaaaaatacatcataacgtaaaattttgacgaataaataaccagacatccaagaaaacagaaatctcttcaaacccatccaaatgccatgagttagtgtacctcatctgcaacgtactcaacttcgctaactccatccagttcgacggtcgcaccgttccatgcgaaaatctgaagcgatttgttgcagtcaacagtagattaacgagagaggtacaagaaaatagggaagaggggaagggaagggaaacggaaggaactcacggcgagcttttggcgaggggggatggagagccaattctccggaggaagctcggtgccgaagatctcggcggtgccggagaggaggcggacgcggagcggagtatcggagccgacctccactctaagctcactctccttcgccaggttgaactgccggctggagcccggagcagtggccgtgccggaggccatgtccgtcctccgactctcttcgaaacctagagcacccgaaaagcgagtctagcgggaaccttttgggctgcggaagaggaaacggtgggaaccccaaattgggagaagcccatcagccacttcctcgggagccccttgttccagagccctggggcgagaggaaagcgtcgataggggcgaattgtcacttgtcaggggtggcaacgggtcggattcggatggaaacaatcgatatctatacccgtctcgttataaaaaatttatatccatatccgattggatcggatgaaatttatttattttatttcgaattggatcgaatcgaaatgaactgagtcagacatcatcaaaatcctcgaacccttaaaaaaataaaatcattcttctttcaagattatgctctcaaaatccttccccacacatctctacttctccacggatctctctttcggatgctctctttcctcacggaactcccaaaaagagaatgaaatgcaaaaaaaaataaaaaataaaaacccttcaatctccattctcattttcctcacatatcttcaaaatttatatgagaaaagatcttatcttctaattttgttcagtctgtcttttgctttcgttgattttttctatgatttatcataattttttctctattttttttataggagtctcaatcaagaagaggtgtgaaacttttttggtttttttttttgggggccatagaagcctcaatctggtgagaagtttggagaggagcggccaactagggaagcttagatattggctatgattttgtgttagatttttatatttaagagtttaaaggtaaggatttttgtgttcattatttatatactagagtttaaatgatatttatatatagtaggtcaggtttacgatagggtatattatcattcgtatccgatctaaattcatttcaattttttttttcaaaatctatattcatcccaaattttaattgaatcggataaaatttgctccgtttggattggattgagtcagatacctatcggattcaacaaaattgccatcactagaattgtagaacagaccgaaggataggagaattttaatgcatttctcgatgttcaaaagactcgaaatcaaaaaaattaattatttatgcaactgcataaagctcatttatctcaactaggctgcaaaagatatgaagtgctagtcggatcgagaccattgatttcattattcaacaaagaagcaaagaaagcagtaagtcaataacgagcacaatctaggagtttagaataggattgatgcctgactcatggaagcatattttccataacaaaagataatgagaaattcttggtccaccattttcaatagaaaaaaactacaccacttcatcaaattggaccacatagtatagttaacaacatataggtatttaatatagctcaatatttttttaaatttttttctgacaaaaatatcctttttctccaagacataggaagtcataataaaccgataaaatatcatataaaaatacagaaagttatatatattatttaggatgtcatagaatgaaaaaatgaggattattattatttccttatgctttataagattttttgtgaatcctatgacatctcggataatgctataacatcctattgcttggtataatattttatatccataatattatttttcaataattgttcataggatgtaaaaaaatgtcatatcattattatgacattctattattttctctaacattattatgacattctgttattttctataatatcttattgattgttatgatgtcatgttattatctatgatattctgacaaaattgagcaaaatagagggaaaagatattttggttaaaaaaaattgaaacaaaacttaagttgtattaaatacttgtctcattattaattacgttacatagcccaatccaatgaaatggtatattttttctccatcgaagatgatggataaaaaatttcttgatggtaacaatcatacaatgcccattaagaatgtagttacgatatctacaacagttatattagctcggctatatcgcacagttggaatgattgtcaccacatgcacaatataagagtcatcacctatcaattattgcacattccattattcccaataatagactccaaccccgttctatatataagagcgattcgaggaccttcaatctccaagcatgtttttctcttcattatctctctaataaccttgcctccctctcaaacctttcattgttttcctaaaatctggataacttaaatattggagggttcccacgaacaaactcaatctcaactttatagtttggattttagcaacaacacatctcaacaaatggcaaggatggtcttggccaaaacacaccatcaacttttcaaggtagaaagggaacaagtgatatgtttaatgatacagaaaataaattcattgatgtcaatataatcgccagcttccttgtatttcttataggttaattggttcaagataggattttatgtagttcatgcaatgtggtttgagaacctttataaatcatttacatccacaaaattacacctgcaaacacacccattgtatgagagaacattcaagtttgtttattatttcattcgatttacaaatatggtgacaagtcggctggtgttgggttcattgaatgattacgttcctactcaactttttgtgtaaacatataataatttttcttcaaaggaaaatatacaataaatatatcataaaatgaggggagtttgccaaataaattctaaatcaagcaaactcattaatggaaatgcccttcacttttcaaagaaatattatctgtataatcatgcctacatttttagcaaataccacaagtaataatattaattatttatatttttttgattatcatttttcattgtcgtaatctcccacctcacacaattcaaaatttaaatgtgttatcagcactctttttaacccaagaaacctttgtcctctattcattatcatactagctacttctttgtatacatgcattgcatgcgccaagttacatttttaatatagaatcacatcgatggtaatgcccagaacatctcatgtcttgcttttatatctactactaatgaggctggaaatgaatcggatatccatactcgtttgtttagtaagtgcatatacagctataggtattaactggatattaaaatttatattcaaatggataaaaacacaaattggaaattgaattaaatgcaaataaattaagtagacgttgtattatagtgattttaacgagtcgtatatttatgagcttatatgatgaaggggaaaaagttcgtagcttttgcattggatgaatcgaataaaacagtgagttggagaagggagtgcctgtcacgccccgaacccaatatccgggtcggatacgtgatggccgtacactccttagagcaagctttaaagaatatgcaaggccaaaataaatcattagaaccttaacatccataacaattgatttcaataataattcataaaatcttgtataggtacaaattaaatttcttcaatcctctgatcaggtactatgacactctatctatccatctgcttatccgtaaatccaagccatagtcaatcataaacgtcctgtaactttgagaaaaaaagaaagatgaagaggtgtgagctttacagtccagtaagaatttccatatcacactgatataataatataatttaaaaataaaaataaacaataaaacataaattcgatgttcaatatccagaataatacaaatatccataaattttctgtattgttaaaatagatgcatcatcatatgttaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaattttttttttgaagaactgtaacattttggacttatattaatatactaccattatttatctaatacatttcactcgaaattcataattatctcagactacccttgataggaaaataaataaaggtcaaacattgggcactcttcacaatcatcgatttctttcttctcttgaccttccaacaaattttatatgtagactctcatcttaagaaaacctccatcttctatatcagttcgagtgacaatattaaattttaaaaatatgagatctatgttaggactttctaagtttgaactaataccagaattatcaagctgtaacttgagatgtctaaaattcttgatattatctacaatgaaacaacttactaacaaaaattatccgactatgatcagattaaaatcattctttatttacaactaatgtattccatattatcttcgaaatcaaagaattaatatttctaatcaatttaaaccaccatgcttttgctgcgtactctgattttaatttatcaaattatataagtctattaaagataaaaatatccttatatgttagatcaatccaggatagatccaaccttcaaatttcatataagacttaggcaaaatttaattttctttatctttaccacttttgagtatagcatataaaagttaaatcttgatccacttcctatgtttgaactcattgcataagtttcatcactcttcaaaaatccgacatgtctagaattaattggagttaaccttagatttatcttacaatcatttagatgatttctaaatcaatctttctttttaaaagaattaattctaacttgacaaactagaaaaactcaagccaacatccttaaatagaatcaacttgattatttcttatagagctcccttcattacaatccttaatattaatcaataaatccatacaaaaatcttatcccttgtataagttattcaaaatttaacactagcaagatgtcttagttcaatttaaaaaaataataatccaaactttgacttgaataattaatacacttcaccatcttcaacaatcacaagaaaattaaaaaaaaatctaatccaaagataataatacgaattattaaagatttcatcataacctgtatatcatactctgacaaaataaattttcttctttaatttaacaacaatatcaaaatacttttgatccacttagaaaagtaagtttttttttttaacttgaaattcaatgtaacttgaagatcaaggaatcatattcagaatatgatattttgagtaaccaaagatttcaccaagatgtgtatctcatattctcataataaaatttaaatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttttttttttttttttttggaactatgggctgattctgggcttttgggcttggtccagggcccaaatggaccggggtattacagtgcccttcttcggtagaggaaagttggagcaggaggagcctctgaagttccccaagtggaatgccagcgatgtgcttctccatgtgaagaacaactagctcgagttctctcgtccctcgacccctgcagaatttgcatccaggtttctgacattttcttctctctctaatgttaatatggattggtgtgagttcaaggatttggggttctttgtttttttgaaccttctaatgcatataatgcgtgtcctctaccttcgaaaagcctatattttatcatcaaacttattttgtggccatcttcatacactgcggaagccaagttgtcccaaaaatttggatattaatgattaatgtggaggatttggaaagacaaggatcatagttgacaaatacgaatattagcatgttactgccattcctcttagttaatttgtatggcatttacttgatttttatttttgctggtgattcgtacatggagagtgtgtgcaaaccatgaaaggtttgccctgctttggtgcctcagcgtccaagtaattattcatgatatggatcatatatttggatgaaaagattgatggaagtccattcctccaaaaaatagccaaatggaaccaccatccgagcaggttatcagttagagtggcagtcatgaatgaggtgtttaagtcattgtaaaatttgaggtgctaggcagtttgtaaaaatactatagagtgaagctcatgtcatgaaaattttggttttcaatcgttgtgaccaaggaaatgagagatgtacgtcaactaattaccaagtggaatggtaaaagcttttggagaactgtgatgatttttgttttggtaaaaaggtggtgaatacaactggccttgtccttaatttttagtgcaacaataaatggaaacttgtgaaggttataattccacgagctcaacaatttatcatgagaccaacccaatatggttgttgttgggctggatcttctggcttggggggagattgcatttgttccactgaggatgatccatttttagataatcatggataaatatttaaatactagaattattgcataagtatataccttgggaccaacatttgtgcaagctgcaaaatttatgaggttgtatgagtaaaatcagatagtttttccctccttaaagaggtccccaacagagagagtttaacacccattatgaaggatgatgtgggtctgctgaatgaaggctgatgccatcaaagctgagccagagcgtctttggatggttttgagcaccaggataaccacatattagaactggggatcaccttggtggagatctaatattgggtagatgaatgtcatgaattatgcttatgtttcagagtgaacaggatagtacttggatggttacatctctttccagtaacatgatcatactttgatagttacatctcattcaagtaaaaagaaaccagagtcaagttttgcattcagagccaggacaacaaaaaaatgagttcaatttttgaattgaaaaataagagagcatttgagaattctggaggcatctgccatgtttttcctttccactcgatattgtacatttcctctgaaaaacaaataaatgtgaagaattgcatttactcatcagtctctaggcccggtacgtactccaaactgacgtcaaaaatcacagggctgttcggggctactcgtggccttcctggagctgaattaagacctttagggaatgctaactgttgagattagagcacaagagtatcacagaattagatttagatgccttcgaaggaccaatgtcctatacatcagaattcggagtgatttttcctaagaaaataaagtgctttactagatagcattctgactcaaatttgctaattacaagagtaatatatttgctacaactaaaaaaaagcaattttattttattattttcttcttccttttgcacacaatatctgatccttgattcaaatcattctggtcagaatacttacagagccaggtatgtatagccggcgctttcctccaactttcatgctcaatatcccttcatcgagtcctttgatcacctattatcgccagagagacaattgataacagggtcaatgtcccatcatcaagtccgatgatcactttcttcagacaaatgagacaattaataggaggatcgttcgaaagctaaatacatcacagagaggtggaccatatataaatatatatgaagatgatataagtaatataacagattgcaaggtgacattttccctcaaggaattgttatttacaacttaagtgagctgagaaagacatgtttatggcaggattgttccagttacaaagattcaggcttccttgaatttgggtgcataatttatagttttgtaatatggaacaagcaatgaggtttcacttgaacaaatcaagttcaacaagaggcggagttaatattccttgcccacagcatatatgatagttttgccaatttaattgctatgcggtgccatgatttggagcaatgatatcatcttaaaatagttttagtgacttcttctgatgacccaaaagcccattattaatcagaaaaacaagcattagttaataaggatgaaaaagaagagaactgatgtaaatattatctgcaaaagaaatttcaggcaatcagcttggaaagcccaacatatcaacaaacagggatttcacagtatataggcttgaaataacatcattagaagaaaaatgatacactaaaagttgccaaacatggaggtcaaatttttagaagacatgcaatggtagattacctgaccggaaccgatgcggaaaatatatggttggcctttctccagggagctggaagacaatataatatacatttagaaatggattaaatgacagcataaacagacaacatattaactgtttatgcattttctcagaaaaaatataactacttcagcatttctaagatgggagttgtatcatccataccttatctttttatttgaggaaagttcattcataccttatcaaattagtcagcagaatatatggatttagttgagttaaatacagcatgaatcaatttttaagaaggtgtttacaagacaaaatgtgcaggtgcctctctttcaaaaatgataaaaaaacacaactaatatgtcattgcattcctaaaccactatcaagcttacaggttcaggcttatcacctatcgaatatttgtccagactgtaccatggcaacatagtttgcagcaacctataagataaagacgggattgggaatggttagaatttgcgaaaaaatctaaaggaaaactctgaaaacaggacaagatacttgcaaaaaattaggaaaacactgccagccagtttttttggtgatttattgttcatttctcacatgtgctctgcatgcctacatggtttccaatttcctgtgttaataacattcttgtggagattgtttcacatatcagttcttaatccatttccaaaagattaagtataaatatctagaaataaggcagatttttacaaagaattttaacagagccacaattagttctcatttcacaagtgagcattcagatgcaaaaatttgcaaaaagaaccatgtctcaattgtttgaggcataaaaagaactacctgaaaaccaacaggtggacttggacctttgccaatttcaatatccttgtactgcaagccagattctgtagttaccataggtacctgaatggagaaaagaaaagaatgtatgatcatcacctatatttaaatgttctgaagaaaaaagtctatgcgatatatttgaggtttaatgcttaaacttcagaagtgatatctaaatttaagaccaaaacaataatgtaattttaaaatattacatggctattttagaaaaaaaaaaaattcacctacattgccagatcatagaaataaaggatatataagctgaagctaaacactgacatccactgtcatccatagaacatcagttattatttcctccaaatgatttcactaaacaagagactaataagccatatcaatcctgtgggtacagtttggggatgcaatacagttataatcaaacaaagggaaactagcatagccatctcgcctataccaagtatttgagtcggtgttgcgggtcttgatttgcaaagcatgtatatttaacgccaccaacaatgcagtttcaagcttttccatatctctcttgtagatctctacccttgctagtccttcagtgcaaatgaaagttcccctcttactagagcctccttagaattcattttacattcccatatatcatcctaatcgatcctccatcactttctattaactcgacctactcctctaatatacttatggtttatcgtatcaattctccatcctaatcgattctccagcttttccattttcactggatgaaaacagtggaggattatgttaggctgacagccagttgcgaaaaacaagtgaaaactgtaaaatggaatgaaagaaactcgagcaagcaaaaaattgtatgtattataactacatgcattctatttatgaaatgatgaccatgcaaagcatgcaaaaatattgcaacttatgtcaatcaaaaaagtcctcgttcatttcaagtcataaaagaaattttattttttaaaaaaatctataactgatttgacaatgaatggcgactctaagagccaatagcagaactatttgacaatgaatggcaactttaagagccaataccttctgctcaagtagatatttaacataatgcccttttgctctattgtcaccataaatcagggacaatttaaaagtcaaacatgaccaatctcactagaggcctcttatgatggactttcactgtagatagttgcctgagaacatattaaagatctcaaatttttgaggaaaattaagggtctcagtatatcctaaataagtaagcaaatgcccaaaggaacaagctttaactgcagatggaaagtaatagcaggttcagactaccacaaaatagaagtaaattcataaaccagaaatccttattgcacctacatgaggttaaaaatattacaatatagagaattttgtgaaatgcaattacttatcaagaaatatgtgtaaaaaggtgtgtgcaaggatatatatcaattgtggtaatgatagatgcccagggaaatgcaatctcaccatacattttcaagctccttttcacaaacatcatcacataatcttggcttttgctctggaggcaaggcagctccattggctttggcaatagctaaaccgaaggcagacatcaccaaaaccaatccaaatgcactcctccgactcgttagtttggcatcctctccataatttctcatcttgacagctttatatccaggctctgaagccgagcagcagacttcaaaacttaggaacttgtgtgtggatatcatataatgactgcaccatggtctcttgggaaagcttggagctatgcacacatacagcttaattagagaagaaagttgcccaaggataaaacaatgacacacgaatcttttcaagaaaaacaaacaaaacactcatctaagtagtgacgaatgaaacattatgctactttaagaattactgcgtggattaatagtgcagaaatctttaaatttctccttcccttttttattctcctctctaggcatttttttcagaagtgattaagaattatttcaagataatgatgttcgtatttaataaaaacataagcatttttattctcatctctattttttttccccacaaaatctctgccttcatctgcaagaaaaaagtaacctatgataattaacgtgttaatgcataatggttatggtagcaaacagaaaacaaggtggaataaaaagaaacaaaagaaaccatgaccaacaagtcattattttgcaaaacaaaatactaagaaatcccattattttttaacaaaaaaacagctgcgcttattaaaaaaaaaaaacagaatttttaagaaactaaaatatatttttcaatgaaaaagagttaaaagaaacacttaacatagtggccctccgtaaaattaatgtaacattataagatgcatttcaaatttctgacacaatcttctcaaggatgaacatctgcaatatacaataagtccgacttcctaaaatcaggaagagaatggatttgatttaacaaacccaccaaacagagtgaattgattcttcttcgttccagaaaattatgttcctagagaactttttcttcaatgctaacatgctcccatatgtacgagataccggtaggggaaaattaccggaattagagtgactcgacggcaactgtataacgctataaaataagaaaatataacaaagataaacaaatgctccacatccacagaaagagagagagagagagagagagagataaggggtcacctgaggggagaagaagggccgaggaagaagccatggctgcgatggacaaggactggatagagcagcgttcatctatccgtgaagagtcgacggtagggaggacgcggtctgagccactcgttacaagagagaacaaatgagaaccttttggcacccacctgcgagcgaagtttaccacgtgccgtagacacagccaatagaaaaaaattcatatcatcattttaaactaaaaaaaaatcctgcaaccatcacaatatactgcagcttaatcatctatatctatctaaaaatttctctagctgcagcataattgatagaatcagttcgccaattcagagtttctagctgaaaaaaccaaagtccgagcaccgatcgaggtgcttgtggtgttgaagaactagaatgctgtcagacagtaacccgtaattgaaaaattaaatatttatgatgttttattgtcttttggttttatggagctagtaagagaatggtaaatgctagggagactataaaatcaaccagcaccttgagatatcacctcaaaaaacactataaaactagttgccataaaatatgattacatgcatgcttttgattgtaggattgcatttggtaaccgacaatctattcagataattgacaatttaaaatagacttatcaaattactatgtttaatatatttttggatgacaatccagattacctctcagaaaataatttaaatttttttgaagagaaatagttatctaaattatcatttatttgataatattataaaaaaaatttaagcaaaattattcttcaaaaaaaaatcaaacaaaatctattcctccatcctcctcctccgacgactctcaccctccccttattatacataataatatgatataatatattataatataatatagtattattaaattattattatatttttatagtaattatactatattacaataatatagtatatgataatatattataatatatattatataaatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttctccactcttcatctctttttttctcactttgtcttgataattaactcttcatcttattactttctattttatatctaacttattgcaatttaaaagctccaattcaaagctcagtaaaatctaaaccatgaactcaagctcaagaacttgtttataaatgcgaaactatatcttaaaaattatagcatattatgagctgaaatgaggtccaagtatatcagaactttcctatttaatttaattccaaactcttagactggccataatttagtttatctggtctcaccaagttctaacttctcgaaggatttatcttgaaattttaagttgacatgaaacaggtattaacctttttttttttgaatgctgacatgaataactgaattgattacaaatttaaaattcaaactctaaacgaattagataattcaaatcatttgcattttaatagaattatgtttatttttatagaaattctttttttgttctgacgttacgtggaccacactaaaggcactacgttcaaaacagattgtcgtgctcctggctagtaatttttggacggatgctcccaactggactgaggtgtgagggcccgaatttattggaattttttagttaatttatgaatcggaaaaatcggagatgattcgaaagcgaatcttcccatcttttctagttaattagatttcagtttttgccctcttcatcttcaaatattctacactttgtgtacatgtaattattctgtttgggagccctccggttctcctccgaactgcaagcacaccacttcgcccgcctcgatcttatccgtttccttccgatcttttctgcgaaaccgattcttctcacctccttctctatagtagagcggagctctcacttcgaagatccatcaggtggcagcgatggagatggccttgcagccacggaggccttccttttgtcggatgatgctttttggtgggacacgattcgaaatccggccggctacacaagtgagtctctctctctctctcgcggatgctctctttttgtcctttttgccctcgcctttttggcttgcggcttcgtttgtggctttcgtatgggaggagagcttgcagcctttcgggaatttaaatgtgttttaactgctgtgaactttctgaaacttttctgccttgcaaactcatggcaagtttttgattttttgatttttttccccttcctccggtttttgttgttgttgttttcggggatccgtgtcatttagtatagaattcgaatagattttgtgagtcttctaggttgtaacattggttgtttgcttattaaatccgtccagaagtgtaacacgtagaatcacaaactggtagaatggatgagctatcttgggtttttgtgctgtataattttattgaatgactagtactgtagactttattgactggaatttttgttaattgtcaacttcctttttcttctttttcctatttgcctgcagtcttttttatggtgcaaagaattcacaagaatcaggattatgcctccacttgcagcaagctctggttagtatgatgatgcgattttggatctcaaggatttcattctatatgtttcatgttctgtttctttgaattgcattctacagagtattcaaggaggcgcccaagaagaagctcgattccccggatgaaagattctcatcctagaggatttgcacctagaccccaagttggaacaggcatccagaagaaagatcaatgtgatgttggggaaaaagaagaatctgaaagcgctagctcgagtaaatattcactttcaagcagtggaatcaatgaaagaaaggttgctggaggaggagtgaaaaggagagtggacgtacttgaggaagcggaggaaaagagttatggggaagatgataaagataaaaaaacctttacaggaatgtcttctgcagctgctgacgattatgaaactgatgggcagagagctgaggatgaggaagatcaagtaggcttaagaaaacagcatctagaagttattgacatgatagccaccgcaggaaaacagccaactgcatctcttagtgaaaggaaggaagaagttgtggttgggagagatgtggaattaagtaagaatgaggaattggggaaaattaatgagcatgcggcaatcacagaatcagacatggaagaatcattaatgaaacagaaggcagatattgatgcacaaacacacaaacagatgctagagcatcttgctgatgaaaacttctcaagtgggaacaaggtatttgttgttccagaagcggtgaagtctgatgaagttattgaaatattctttaatcgaagcttatcagctttggtgaatgaacctgatgttttgatcaagggagcattcaatggttggaggtggaaattttttactgaaaagatgcacaaaactgaacttcaaggggattggtggtcttgccaactttctgtacctaaggaggcatacaaaatagattttgtgtttttcaatggcggtaacatctatgagaataacgattcaaaagatttttctttacctgtagaaggtgagatggatgaattagcatttgaagatatcttgcttaaagagaaacaatgggaacttgaaaaacgcgctgcagaagaagctgaaagggaaagaaaagctgaagagcagtgccaaagggaggcagagaaggctgcaagtgaagctgacagagcacaggcaaaggtggaggtagagaaaaagcgggaagctcttcatcgagtaatgaaattggcaaagtctgttgatgatgtctggtacattgagcctaatgtattcaaaggcggggacatggtcagattatattataatcgaagctctcgcccacttgctcatgctacagaaatctggattcatggtggtcataataattggattcatgggctgtctattgttgaaaggcttcttcgatctgaggaaaaagatggtgattggtggtatgcagaaggcacgtataattggtctatgcttcacatctatgttatactataattagttaatgttgtatacagcatttgacagatgccttcacatgcaattccataacattaattgcgaaagatgtcatcaactgatgctatgctattggaagtgagtatcaaaatgtctataacttaagaaaactagaacttttatctgaggaattatgcatgacttctgaaaatgacttggtcataaaatcaaaagagctactgctagctagtttctcatgaatatgaaatttaatgcgaatattgaaggttgagattgggttaaagggaaacctaatgcataagtggtttcctttagtatctctaactcgaaaagtaatttcatttgcatacttacagtgtataaacatattttgaacaataagtataattttgactaatttatgaattattgtattataaattatcatggacttttatggttattgatgcatgtattgttgcctgtagtttttgcacaactatgcatttacatcaacaacatgagtcctcaaaattcttggtaaattataataagcggaagtatatctatgttcactaatttacaacttattttaggtgttgtacacatactggtggtaatatggttagcttgtaaactggtaatattgctcccaatatcacctcatttactatatttacaccagagtatcgtgatggacttggaccatcattattaggggaacaactaggtttttcaccaggtgaggggaatggaatcttaattgagggaagtatgggaattgtaattttatgtgctacattttacgttaaaatactaatgtaccaattaattattatcaattgatgtattgcaaataaatttgtttagttacaaagatatataagaataacttatcattcatgtggaacttgtaagcattaaaagaaacttcaatctttaattctttataacctgataagtttgtgatggatatcaacccatcggtgaccaaacaattatgatttttcatatttctgtatgatcactatgttatcattacatgcttctgtatggtcataatatgcatcctagaagctgtagcaaagaaggtaaactatttcttcgagatgacaaataaataactatgtgcataaagaatctatgagatttcaaggaatctgtaatgaacaaagaaaagggggggaaagaacactgatggagaggactttacctcacacatgtaagtggatccccttcttttctttttctttttttttttgttctttttttcttttgatgattccaaacaaaagattcatgaagaaagataaatgtctaccctgccccaacatctctctcttttatccatgaataagaggtagtgtaacttgtgagttcttcttctttgattggatttcagaataaaatttttctttctctaaaatttacgcatttaatattatttcttatttactatgaggtcatggagtattggtggcaacaataggagataacaccttcttatatgtaataaggctttgagaagtttgccatcctttttgttgggtccatattaaagtgtattaatgggcttaaagggaagtggctcatggaaactttggcgggtcatgccctatgccccccttcctcacttccaacctttactgccttcaatgtaggtaccagaagacatattaataatgcatgcatgtgatttatcatcaggctaatagcatatacttttatattgtagctcaaagtttgtgcattttaaccaatgaatgtctgaaatgggatggcaaggtacatgcttctttatgctatattgcttacccttgtgatatcttgggagtgtataactggatcaactgttgcgatctgtctacaagcatttctacgaatctatttaattaacattattttacagcatttgaagtcaaaacttaataaattctacttttagcgctactagatcaatagtttgaaagcaaatggtttctctctttatctctccacatgcttggcataaaaccttcttttcattttgcttcttgactacaatcctgatattatcttatatgtagcaatttctgatttagtccttttatgcagttgtggtacctgaccatgcacttgttcttgattgggtttttgccaatggaccaccacaaaaggcaaacatgtatgataataacaattctcgggattttcatgctacagtcccgaattgtattcttggagatctgttctggattgaagaagaacatagaatctacagaaagcttcaggaagaaagaaaattaaaagaggaggctgttcggaaaaaggtcaatcttaaccattgttatagtctgcatttgatcatatttcttctgaaaggatattaccttattatttcttccatttcctttttcaataagctaaattgtaaacataacagaagaaaattttttttgagtaatattgttattttggttctcataggctgagaaaactgcacgcctgaaagctgaaacaaaggaaagaacaatgaaaatgtttttgttgtcccaaaaacatatagtttatactgagccacttgatataagagctggaagcatggtcacagtcttttacaatccctccaacacggttttaagtgggaagcctgaagtttggtttagatgctcatttaaccgttggactcaccatagaggccccttacctccacagaaaatggtgcatgcagataatgcttcacatctcaaagtgactggtgagaatgacatctagttacaaactcttttatatcacttattcatttatgctatatttctatatttgccatgtttctacattccttatatctaggtcccttatgactgccattttccatgcaacattggttgtgttcatgcaatcaatatagttagtactaaggataatgtcgtgtttgataatgttttataatttgtatctgttggggcgaagtcagcatttagtcttgtatcctttggagaaaaggccagttaacttaagagacatttgtgtgttttcttttctttttcctttttttcttggaataggacaatttacatttgtacctgctattataacacagacttgttggcttgcatatctaattcttcacgtctcctcttggcatttgtataatgatacttctaactttaacaaccacaccactcttaggatcaattaatgtgaaatagatagagttccttctaagactaatgtccataacttaccaccattaaaaaattcaaattttaaactaacaaagtttgaattattacaaggaaaaatttggaagcttgagtatcaccaaacttaactgacaaacttgtctccaggcatacaagtttagttgtgtgaaagattccagtggctcattccaaattcatattaacagtttagcctatatctgggattgaattcaataatttatcatgggagcgcatgatttttcaggttcatcctttaacaagattatcgtacattcctcctacattttctgtaccgattctgatttgtttggtgatttttgatcttcactaaagccaattgattttgaagccctcatgacatggagtgaaaacttctattctatttaaagtaacttcggaaaatccaaacatagattagagcccttagtctgtgatttgagcaaacagttttataacttgcaaaaattttgcatatcttcatctttctttctttgtttttatttttcattaattgtttgagaacaagatattgattaaacactcagccaagcagccggaatatgttaaaaatttttatatcgaaaactacaattctaatgtgcatgtctcgtatgatatgctaatgtagttttgattcatttttgtcattaggttataatgaaatacagctttcgactaaattttccttttacatgtttatttgcatgtagattatgaaaaaaaattactatatatatacattaatacatatgtacttacatacatacatacatgtacatacaagttatgccatcttggtaccggaccccaaattagtgccaccctattattgtgttgatatgcttggtatggggcatcttcggcgtaccgagtgttggttcgcctcctgtactgtatactggtatagaattggtacggtaggttccataccacatggatcggtatggtgtggtgtaacatgttccatttccaatatcttatgttaaaggaatgaaatgtcattttttctgctgttacagttaaggttccttttgatgcgtatatgatggactttgttttctcggagagggaagatggtggaatttatgacaacaaaaatggaatggactaccatattcctgtttctggaggaatcttaaaggaacctccaatgcacattgtacatattgctgttgaaatggcacctattgcaaaggtatgttttaatgcttatcttctttctaaagcagcatgagctacctggtgtgttttttgcctctccagtagtacactcgtgctctcaatttgcagacagtttgagagaacctgatttgctgatattcgctagtgagtgtgaataacaaaatgtggagttaacgtacaacaccctggatgaaattcatgaatggattttaaaagcaaaataaagttactcagatgaccctcaaaatagtgattggtgaaaaactaaaatctgtttttcgtaaatggcagggttcactagtcttgtgataatataattgcacgactgatgataaggtgtttggtctacttttgcttcagtttccatgcatccaatttaattgtgttaaatattacttcctgctccacaatcttagtacgttgattaaaacttgacaaggtaaaattctttggtactaattgtttccttggaatttgatgatacttgtgccgcaaagaatatgaaatgcttctatcagtccacttaatatatgcaataaatcagctacccttgccatcatctggtctgcatgatgagtgtgccttatttgagttatcaattgccttatctggttttaaaaccttcccctcaaattctgttgaaatcctggtggaactatcttcagggcatagaagcactatataacagaacttctattatcaattggatcgattttgttaattttactcaatagtagtttatttaaagcttcctttcatgaaatttacttttgggctcccctccttccctatccttgagcttaaatttattgccccagtatgggagttgaatctggcccgtgttctacatcaaaagaatatttaaataaatacttgataaacgtgaccataacatcaagccttgtcccgattatttggaatggtctttatgagtcttttcatttgctaaaatttccaatttagggctacctctgattgttttgtcaagctctccgtatctttttcacagcgttcatccttgacatcttaggtcttctcttatccttacattttcaaacaaaggtactatccttattgttgttctctcagatctttgttttacgttgcatagaacaattaaatctacatcactttgtccctgttcattaatttgtgcaactcctatatatcctgtaatatatttatttttcctttaataaccaaggatgtgatacttagctcctgtagcaatgctcctatgctttattacttgaagctagatagtcaaaatgcattatttgataagcgcagggttgataaattttgtgtagtgccttgttgttgtgaatataaagattttaaacaagcttttgtccatacttatttaaattttaattgataatatgtatatttagtttcggatggaaatccttaggtcaaaactaagttctagctacaaagttttatgcttcaactctattatgatattaaaccaatgagtagaaatatttttgcatgtcatgcatttaatgcctatactttgttgcatatctacaagtttcatgtactatgggtgagcaggcaattgcccatccccattgtaattgtacttatttggtttttacccctatgagcggataattgcagtcttgtgtttcattctatactttatccgaaagttccatattgttggagatcgatttcacaaccatgagactactataaaacctctagtgatttattttaggagatcagcaagagtttcattggatttgataatattgggaagcacgtgtggagacatgcaagcatgatgtcttgctctaccttgctcgttgattacatgaattcattgggtgggaataccatgtcatgaggataccatgagaaggaagaagtgtattatgaagtaaataccttcaatgataatgttaatattcatttatctactaccttctataattggttggccgtataacaaatcttgattagtgagaaccaaatgatggcattaaaagcccatcaaggtggggccatggtcctccaaggcaccaaaatttttcattcaaatcttgtgaccctgcatccactattctaggcaagaaaggctgaaccggtaccagacaacgagttggttggcggtcggtgcggtatgatatcaatttggcaccatccgattatggtttgatcggcaccccattttttttgtttctttttttgacttataagatatctaatcaattttttattatttcttgaatgattttaagtttaaatattgtttctttatcttatttgatgtttgtatcatttcgatacatccatgattaagcgtgtgatatggatctcaatctaacataatattatgttagaggaaaacaatcttaaagaactagatattattgaattttaaaatacttaaatcaattaagaaaataaaaaataaataaccaatacatatcgagacttagaatctcatcgagcgtcgatgtcgttcataaatatttggattatttacataatctggtgaaacattagcccatctctttaaccatgcagtactgtaattctctgcgttcatcccataaggtatgcatgctggattgtaagttgtttcagatctctctttgaagctctgactctgagaggtgttttcggattgatagtacggttatggagggatccatccaaatatactggcagcaaaattctatccgtaagatgctccgtgctgtatagggtagtagccgttggaagatgatgccttgaacgcaccatatctatattcatatggatcataaattgcctatggttgtcaataagaggatccagattatgatgaaccagatatgaccatggatccaacttcacgtgcgaggtcatctgcagctacatgatgtcttgaatgaccttgaggggcacgttgtctgtatgaaatcgtattctcacgagctccatcagctcgtatcccgtggttcttatcctgtgtggcatgcgtaaattgagactcatcagtaaattgaaggccatcttgcagttgtatcttataaacagtggtcttctatcctctgcttcctccatgacaatcagatccatgactatcaggagaactaccatcaccactttgtctagtctctgaatctaagtgactggatcaattgactgctccaccctcttcatctgggctgacattgtctttcctttttctttgtctctgcattgagaagttgcttgcccttttgtcatgcctcatgaggaagtctattgtggctgatcagctggaagcttgtgtggaatattactgattgtctattgctcagcatccatcccaacttcgctagttagaaaattgactggtcgtggaggcgatcctagcttatcaagctccggctcctattgctgactcattatctatctgattatcgaatttttctcatcatcaataaaatcattcgcagtcggatccgagtatttcaacttaacttccttttgaatatattttagtctcaacctcagattgtaatgaatatatacaaggtcgttgaggtgtttctgtgtcagatgatttctctgtttgctgtggataaggacgaaggtttaccaattacgctcatagtcactcgaggagattgtctgggagaggatccgaatggtaagtcactttagagtaggcgctgccaatccaaaataacccatcactaaggattggcacccaattttaattgggaggctccataactgtataacataatctcctctaattctagattttctatgcatgatccctttgtaatcttgctttctagatggacttggctgtttgttatttaaacattgattatctgccgttctctccccaaaactaattccaaatcatgattcctcttttgatctgtgccttgcacccaagacttcatctttttatgaaattatacaatttttattgagtcattactatcaaagctgagtgccttttgcctgaaccatatacttttcctgaaaagaacataaaatgatgtgatcttgctccatgcccatgtatttttctttttgcctaagaacaattgcattatgagaagcgattcaataaagcacactaaatttatattgcaagttgtttctttgtcagtatgcattcagttcatcaaaaaaaaagcgttgaattctcaaggggattaaaatatcccatctagatagcggatttctataagtttcttggggggattgtaatgcatgcattattttcttatgttaaacattaaattataatataagttttaaaataaatatcaagcactacatttagttgctttgagatcaatggtattacattagattgttacaaggaaaaaaataacactaaaaacaagaataatggtcattagttttaaatttatgatgtgaacaccaaaactgttatgcatttgaatgtttgttttatacatcaatttcacgttctagcctaaaattttacccctacatggtatgaattttagtgatgattctaatcatttggttgtatgattttcttcttctgttgcaatgcctttcaaggtcatactaatcttttgaataagttgaacttaaattgtaattatgtctatatatcctttaggaaaatagtgtaaatgttggtgtatttttgccctccctaaaggaataaatcttggctttgcctcaggatattgaggcagttaataaagaaaccatgcaacaaagtaaatatgcagataaattctttgatgttataccaggcgattcatcttcatatgcttgaaactttttaaactttggacatgggtgtcacacaagtgagctgttcatgagcaactcatgttgggccaggtgtttttggcttgcttaactaataaatgatctatacatcagctaggtttttgaggttgaatataaacaagctgatcacaagctagaccctgctcacttctattcagcttgacatagctagaaataaaaataataattattattatctaaataaaaaatatttttatacttaagattcatattttaagtgaggaagcacaagaatccataattatattgtaatatgataaatttaaagattagctactagccacttcaaaaaaaagaattagttactggaattagcagttatattcttgaatcttaatccaattactattattcatcaggcttctaatattggcccttttcctttttcaatccaggaccgggccataggtccatatttctgttttctgcatcctctttccaattttgctccaaccacttattttatcttctccacttccgatattaggtttctggctcttttcactgccttcttcttcctttgccattgatgacggtggtgatgatatgaggctgatgatggttattacaataaatatttgatcttctctctctctctcacacacacacacacgcgcgcgcgcactttctttttattcatttggcttccatggacccccgtcactccctcttctatccccttctgtcgcaaattcactcactgttgttctttttcattgatttctttttcccatctgaagaagatatacggtttcaagctacatggaccaaactcgagctggctcaaaattaaacaaactgaattggagatgatcctttcgagcatgacttaaacttgaggtagcctgattaagttctgagtcaagctcaagcttgagctaagcctagcttgctgaacttcagctcatttacacccctaactttgggttggttgcacttaattaatcaaaatatggggtttttaaggagaggatagtgaaagaaagtcccaggtcctcaacaagtagtagaattatgacatcctaggaccatacctaaaatgggctagcttgaagattattaattggggtcctttgccttgctcaagtgcccgagacctcctctatgcacagatgatgtgggtctaaatgcccttgcgggcctctcatactcccctcattcaagccctaccatccacattaaggaaggatccggtcataaaaaacattactggtttggttgtcagcccaataaaagtatgcatgctgatcctgtagctgcatgggctgtgtgttgagttggttctgataccatttgtaaccacttgggacctcattcaaaaagggcaagccagaatgttattaattggggtccttggcatttcttatattctaagaactccccacgcgaccaatgtgggactaaatgcacacacgcacatgcatgggttccctcatgaatgattggaaaggttgtgtcgataagccatatcgctgttctcagtttcaataccgaagtatgagatgatagtttgcttggcctcaaaaagtgatcaaggactcaacataatagacatatgctagaccataagtaattcgtgaagacaatcttgatcctttacttcaagtgttaattagagatacagtttgtgaaaagcatcatccttgatatttgataatgcattctacatagaagaagaatggtaaaacctgtatcaaaggaaaacaggcatgctgtgatcatacccataataaataatgcttgcttttgttataatctgactaaatttctcaaaccagtccctaatcgcatgtaatgaaaataacaagaatgctgggaggaaattgaaagatcagggttagctaaaataagctgaattcttaaatcaccattaatgaattctattcttcatatgatctgacagtggccatccatggctgcaaattggcaataagagcatgaatttggtcatcttggcacctgcaaaaaatgctttatgcctctatgtcattctgttgggtaaagcatcgggctaagattcccattatgctgctctatcaaaccttccttctaactctaaggtttagcatgacagacttagctgcacaggtagggatttcctaggtggaaggggaacaagatcttagatctaggcatgttcaatcttatgaccaatcaaggaacctatgtttatccatatttttaggtgcactgaagttctgttatcatcgtcatctgagttgcatggtatgtgaagttttagaatctcagaaccatactgttaacattttaaaaaattttctttcagtttctacttgatcttcttgattttaattgcctgatgcattacagggatctattacattattactttcactacattgattttgtaatgcaaataatattttctattggaaacttaaaacttaaaagcatactgtttaattagttatctgtgatagatgtaagccaggcatataatattattttgatgagtaactgacctttttattgtttaccgtgccatttctaacttttgcaggtgggaggtcttggtgatgtcgttacaagtctttctcgggctgttcaagatttaggacataatgttgatattattcttccaaagtatgactgcatgaatctaagcaatgtaagactcttttgtactactctttaatctggcctattttttcatagttttttctttttaatcacataatgcttgtccatgaggttcaaaccactgcccagaagtacttacatttatgaaatgcttggctttttaagcccatgcttctgttcattgtgttggttgaaactgaactgagcacatgcctctattctgtcaattgttatcacaagtgtatcttgtggtgttcaagtttttgcccataataccaatatcatttttcttttcatgaattaagttgcactcctatttccttaataactgcttctgggcacatgtgacccaaagtacacaaacagttcttacattgtattaatttgtagtagttatatttataattgatattgtatactgtctttttggcatgtagtaaaaatgaatttgggagaaaaaaaagaaaaaaagagatgaatgtatgctcttgtttccttccacttttgtttttccttgggaatattactttgatctaataatgactaccatgttaaatgagttttttgtaaactttgcaaactgcatatgtcattacgttttctggatgctagttggcaaactgtttattttttctgacaatgagctaaatgcaaacttaacttgtataattttgtggtctgtggtgctcactttttgacatttctctcaactcaaggccaacacctcttaaatgaaaagggtgtttaaatgcctatgattgaactctaatgctacggattcacatgcaaggcatgagaatgtaggtctagtaagatcctagggttcagaacaaacaataagctttctgtccagaaagtttgcaggtaaaccaacaccagggattgaaggataaaccaaaagatggttaggtagaatatttgatgtttttagggatgagctaatataattaatgggttaagatggggtttgtgtcatttagaaaggatcttttatatttttaagtagattaatgtatagtttttttagaaatttgaacagagaaaaaggtttgtagtggaaacagaggttagggtatgttcttttgagttttgactagtttactagtatctctagaagaggattggaatctgcttatcatcagatttgcagcgatgaagatggtggaagtggaaaaactgatggaaaaaagggagactgtaggaaaagaagaaagattggttgatcctggcatctctctacgtaatttgaggatcacttaagaactagcatatgtgaaatccatgtgactactaaagaaagttttgtatagtaaattagctctatcatgtttggaccttgtagttcttccagtttcattgtgtaattgacagagaagagaaatgaaatgaagctggtcctcatgggagtagctgcactttttatgtctctcaaaatgagaaatgagaagttcagtttaatcccaaaactttgctgatgtcatggcaagtgacaaacaaattgtctcttacaaaaaaaaactttcaaaccaaaaatctggattcatgccgcattgtagatttgcagctggctgaagtagttcacttccactttgtagaactcacccttaagtttgagaatgcacaccttatctttgtgacaaatccaagctgccctctggctgtgaggatgactcatagactagtcaatggcaccattcgtatcagcttatttttccccatctcttttctactactgtttgtttgcccattagttgtttcatatcttgggggcttgatcaaattttgagctctctttttgtcattccattcttgttttgtatgtctttttgatagattttgatagtcatgtcgagttgccagacttgatgcaaaattgaaaatgcaatgacgatgtggtttgatcagaattgatgatttgacatcttatggctgtgcgaagtgggggcaatgctaatgggacatatctgttgattttgtgtagaatgttaatgaaagttttcggtagaatataatgttgacaagattctgaaatacccttgttattggtgagttgccaataacctatagtggatggtgaggtgctgtctttttttgattgaagctggtaagaccctgatatttattgaatagtttttaatgttgttgctttttgatttatagcttatgtgttcattaaaaatgtgaactcagatcatattttgacaatagacattggaaaacatctgaattatgattgccttatggtcaatcaggggaatcaaacttgcgatggtctagcattttttattgccatgttctttccatggtatctcaagagcttgatcatgaaagaagtttggctttgatcatggattgctgtaccacctcatatcatatagtacgggacgtactatatcatatcgggtgggaaccaatatgaaactaaagttcggttcggtacaggccccgtaccatcttgtaccgctttttgtgctgaggcataccaagataaaaagtgataaaatggttggaggtctatttttgtatgggtgcgtaaaatactgtgccgactcgcatcatattgaactagtaagatactgatatgatacatgttactgaaattatggaccttactttctatatatgaaattataaagttgatcatcgcataaaaaaacatgagtgacatcaaataggacatcttgtgttacttgaatacttcgtctagcttaacattttggcgtttaatttatatcttgattgatatgtgccagactctcagatgcttgtaaaattctttatttgcagcttttaggattgcgaaagagttttatgagtttgaggcaccaaattagaagtgtactttagttttttcagacattgcctagggatgcaaccattaaactaaatgtataaactataaaatgttgccatgtttgacccttcgtatccctcttttcatccattcctttgttttcctctttttctcactctcaccaccaaggttctctgtatcagtgttggctattgtaccgatactttattagcatggtacggtgtgaaacgatcattatgatgcaatttggacatgtcgattagtagttactcatgctcaactatgaaattgcctagaatcaggcagtatgggcatgcataacatggaattggttggtatgggtcggtttcacttggtttagattagttttgctcagatattgaactaaatcttggtactatattagtatcttgttggtaagtttgcctagtacagggccatatgggtcaatacagcaagccttgctcaacactaatatcctttttgtgcttgctaagttattatattaaatttcaacgtatgaacttttaacttacacttacaactctgccaaaactcttttaatgctattataccttcatattagggggagcgagaaggaaagagaggaaaagagagggagagaggggagggaaggagaagggagagggagaaggggcctctagaggcctatcggaggccgtcggaggcccatcgagggtgctggaggcctggaggcatcggatcgaacaagggcttggcccttgtttgatcccttttttttagcgacattgggtaaagtctgcaaaagtcggcatcatgatgttaatcacaaaaaaggaaacaaggcccctgttttgattgggaggagggtggagcccctcctattgtcttcactggcctcgacggtggtgggccggccctctggaggccatcggattcctcctttcgttctctctttcctttcctacctctgccctcctctagtttccaatatgtgcagcgattccggcagcctctcttttcttcttcctcttcttccttctcccctctctctctttctctctttccttctccctctcctacttgcccagtatcctgtttttactgtcagaaccgtactggccggccgtcggtatggtttggcatgcctcgaaccatttggttcgggatggtttggcaaatcctacgagacactctaacacatagggcaaggtcagcttaactcttgattggccaaattccttaagtctatcgattttctcttactctggaatgagacaaacacaataaggtaatgcacaaaccttgcttttcctcattgaggcccagctctgtacatgcaggttgttacaatttgttttccattgatgaaggacccttttttttgtaatttctctttttttctttcttttatgctttttatggttcttttggttttatttttgttttggtcatatattaggttcaggtgagtttatttcctttttttgatttttttaatatcaaatattgttttttttccattgtttcccctctctttcttcttttcctttcctttcctcctcttcccctttgaatgccaacaactaaagaaggggactagaagcctgtttcgtgtcttcattggtaatagtctacactggctggttcagtccatgtgatgcttggtagaaaccaagaccaactgggacatcttggtaggagggaattaaggtcctaggtgcatctcagggcccaggtagtgaccagcctgatctattgactagacttaaacccttggttttgactaatggcctctaaatctcagaatcttcttacataggtcggtgatgactgatgatttctctttctgaagagactataaggctctaatataaagcttggatattcaatttttaaggggtgaccctagggttcaatattttgctaatgcgtctgaataaaacctaaaatctcaggtccttagctttaggttcaacatggggttcgttggctatctgggaggttctggttctatcaacaaacctagaaccttatcatgttaaattatgctacaggacttgttcatacgcaaaaacctgataatccaaaaaatattgcatacactatctattgtatataaattatactccgtctctctctaactctgtccaaactgcccagctaaggcctgataactactcattattctatgaatatgagttccgcttttatcaagtatgatttaggcttgcgaatcaggtttacttgcacatggatgatttagttttctatatttacagtcagatctgaccgaaaactaacctgttgtcagttctaatttctcgtcttgtatattaggaagagggttcattccttagccagttgtggatgccattctttggactttatgctagcatacatcacaaacacttatgcattggcatgcatcttgaaggaatcgtgcacaatgccaatatgaaacttatggcttttgcagccaggtgaaacacaatttttgctgatcttgctgatcagctaagctaacccgcttgctttctgaggcaggattaaagctctattttgaattatatctttattaatttagaagtccgctttgaggtacaggttagaaagttcttaagtcaatagccttgttttggagcagtttttgttttctttctctatggtgttctatgggaatccaacattaattttcaggaagtttagattatattgtgcagtgaaagggtcttaacttggcaagaccttaggaatatgaacatggtctactaaaattctatgattcactgaattttcttccttgtcagacttccgtatatggttttaacagaaatactgattctttttcttgttagagaagaatattatgtcctcagatgctgacagcattacataattctatattcatctctcttttcacacctctctctctctctctctctctctctctctctcacacacacacacacattttaatcgcacaatatgtgctatttatatgagttgctatttcgcttccagttcccttagttccatcaaccataaaggtcccttgtgactatcaagtttgtacctggcatatggtttttgagtgtgcttgttggagaacatgtagtagcttgtgtttctttaccaccactacagaattcagatttcaggaacttatttctgtaactttcacttgtatacatgtttataattgaaattttcctacttaactacctttgtcgcaatgtaggtgaacgacttccattttcgccgaagctttggttggggtggaacagaaataaaagtttggtttggaaaagttgaaggcctctctgtttactttctagagcctagtaatgggtaatgtagtaatttagttcatcttctactctctgctggtaatcttttaagttttccaaaatatgtgctttttaaaataattaaaaacatcgttccgtttcacttccaacagtctgttagaatctgctgtttcagcatgtcgtcacctataggtcctatgttctattcatttggctatcttgtacatgtttcaaaatatgaacattttaacagaacttctttcttctgttttctctagtagctatgtcagattgatggttaagcatgttgtcacctgtaaatcctttgtgctgttcacctcatattctttcattggcagatgtctgagtgttgcattttaaatcaaaactatttgccatgttactttcaagttatgaaatcgcattcaaactttattccagctcattgatgctctatgatccatagttccatacaaagttaatccactgtatttttatagatggtagaactggatcccttctagtcttattttttgaagaattgctgccttgtatgaccgagccatcattttgagttgagatttggccataattggcgctcctaaaagtgaactgctagaaggatattaaggttttgaatattcctgttagatgtggcagatttgaaatggttttgctttagaggttatcagttgtgttgtttcggcttggttctactttgagtgcacttttatgggctgtttcccgtccatttctttgcacctccagtaggaaaaccattgtctagactgagtcctcttctaatttgtaacttaggcatcttcctttacttaatcaactatcatggcaatcttttgcccttctttttcatggtatcggcaaattatcgtttgttgtttaatttaatgactaccaataggcattgacctctaaccataaactagccattctcgattttattagtctgtttgtaatagcttgtcaagtgatgcgttcataaatatatattcagattaactaaaggcatcaccttatcaaaataaatccagcttgtgtttgaaggtgaaacttgtgccatttatgtgaggtgagatttttttaaaaaaaatgttcctgtatttgtgtttaatctagatggttcatgtaagttatgccaccaactgtgttaatcaacttcaaaatttgcgtgggccctaggagatgtctggtgcgggacctacatcacctgtcaagctgtgcaagttggtgcccttcacttacacagacatgtagctcttggtgataggctagatcttaggcacattaagctttttctacaagattatactaattatcttaggttcttgattcaaggatatccatctcttcaacatgagcatgtatgcaattttgtacgctattttgtctttttgcatttgcactttgagagatatgatatttacgatcatattgatggaatgatacaaaaccatctactttttgactcctataaaattgtgtgctgctttgacttctgagtttatcaaaaactatattatcattttgttgagccaaaatctgatcttcaaattctcccatttatggacagtaggtgaactatggacctatcttcttagacttattggttgtctactagggtatgtgaatatcatttgctataccataccgaggtttagctcaggatgttcactggtagcttgattcacaaatataatgttttgcacctttccttaaatgaaacaaaaatgcttaaacacaagcatataaatacattttggaataacagcctctaaaaggtatgcttgttgaaactttacataatattatttgtcttaaaaagttgatgcatgattgggtcaggctttctgtggccccaaagaggcttagaattaggcggcctgttcattctttttgctgctttagcactgctattcatggtgtttaacatgttttcagtgagaaacatgccatctgctgattcaaagatggtaaagtccaactcgcaggactttttctggtttctgttctttgctgacagccatctttgggcagaaatgagtgttaagataggagttgcacaaaaggacaaagtgatggaaaattgatttaggaggctcagtaaggagaggtactttaggttgtgttgaagcttgtagagaaaggagaggaagacctgaaataacatggatggtggttgtgcggaaggatatggagaatcttggaattacatcaggaatacttggtgaatgaggatccataaagccaggcctcatgattggcaaaaggctggatggttgtggttatggttatttcagtttgttttagttttgagaatgaaaatctggtgctccctctcctcacctgctctttcttttccatctttgcttcttgattttttccttcactttcctctggttgcagctatctgctgaaactgtttgtcggcataaggaaacattgttgttcaattgatcttttattctatttcctaacagccaaaaataatgcaagaataaagaaatatagtgctgataagtcagatctgttctttcttcttccatctcttgtcttaattttcctttcttctgcattaaagttagtgctgaacctttcattttagaacgtgaataactgacagagactcattaagtacctgttcagattttagatcaagcattagaagctgttaataaaaattccattagcaaatacaatccttggaaatcgaaaccatggaaatcgaaaccacagtgatctctaaggtcttaaccacttcttttcctgtgccttaaattctagttatgatctgcaaaagcagagatattgggatagcaaccgcaaaaatcctctaaagccctgaataactcaatttattagcatatcaaaagcttttacaatggccaaaagccctaaaacttcatgaaacttgtttcttgaggagacaagatggtacatcttgaaagctaaagattcaaatataaaattctcgactctcttcggcctctttctacagacaatcacaggaagctatgtttcctgaggatatgtgggtcctaatgtttccattgatgtccttacgaatgcctagatgtatctacattagtctatttaaaaccatacagaattatggaactatcctatttcttctaagattgtatggttattgtacaacatgataagaactaaatatcgacttcttcctcattatcccatttcttcactgatttttttggtacagtcttggattttcatttcatcgtaatcatatcttcttaccatgtaaacctattgttttcaaaacaataccctttcagattcttgtgatgcacgatgtgcttattattttgcatcattattctttttcttctgtttgtatttggatatactgacttttcgtatcattcttggcatcattgcataagtgtcttggattagggtgatgtaaatcttttagagagttaagagattactcaaaagttctgttttcttgatccttatagatactgatgcttccatgttatattttgagttcttattaaatagttaaaagctaaaaaacagactttagtataaatggattaatatatagaagaaattatggctgtaaatttattactttttacccatgaacttatatataacttggattttgtgtctgttatatgtaattttattgtatacaagttctaaagatcaaagtttagaatatctagtaacattctttcctgcaacagagtcacttttatgaggatacattacctttttgttttgcagaatgttttctgttggatgtatctatggcaggaatgatggtgatagatttggtttcttttgtcatgctgctcttgagtttctactccaaagcggatcttgtcctgtaagttaaaagatatatgcatgcctgtgaatattaattttttttgaaaattttaatatcttttcatttttattctatggtcacatttttatatgctttgttcattttattcgtatatgtaggagattttattggcatagttttatgattttcatcaaccagaaatattaccttctaacataaaatgcagaggcagtcatatagatgttggtgctgatgagccctacttgatcgatcatgttggttaaataattgaataagtctgcatataatggttcagatttcagaagctgagctatgctgattattaaaaggcctaaatatggatgcttgataaaattagtaccagcatatcaaatctgaagcaacaaatcatcatgagtcgaaggtacaggaaaggtttgaaaaactgatcgtactgcggtaggatactcctctactgaggtataccatggtatattgaaggtgtacagtatcataccatgctattttagaccttggacaaaccatgagtatgtatggaggtgtaccgcggtacatgccatacttagttttgaacagtacaccctgtactgagtatttcaaacctcgggcaatgtagtagttcaagttacattgcaatttgcattggctcaggacgtttgctatcaaaataatccttatgtcatgtgaaaagacaggtggctaattataacactacaccacttggttatttaaactgaacaagcctaacacagtcatgatgtgatggttgagacacttgcattaatgaggtgaaatttctcctttttcattatgtttgtgcatagatagcatgagatgtaattccttagaatggtaaggcgttgtaggaaatgcagctgtttgcttagtcaattgagagaagtgtatcttaaatttattttttcttaaataatagtcagcaatcgcttttggtgactcattcacatggctgcaagttatatctgatgaccataatattaatatggtagcagtgtttgtttcttagttgcttgagaaatgattcattcaacactaacggagatatgtttttatctcatagtttttgaatatgtcattgactcgaggaatacatgtgtgctaatatcagttactgacacttggctaaattgtttagaccaagtcatgagtttaaatatgagtggcctaatgggtgcatgtgattgttgtcaggggacacatgagatgcctcaattagcaatttgtgcagcttgaagctcgggccaggtcaaataaatatctggggaaaaattgcgttgctaatcatggtctttgaggcatggacacagatatgcaatttggattcaacatatgtagataggatacaatcgttagaagtaggatatgatatggttgggatttgacaataaacaaaatattttgtatatgtgtaagaagcatccatacagtaacatcaacatctacaactctactggttagctactgtttagatctgtcagccacagtccataacaaaataatcagaagaagccatcacttattgcagatatttcgtattttattctttagaaaaaaggaaacatgtgggtgactgttaggaaaagatggttttacttttaccgatttttgattgttttcttttcttttatttttttcttttccttattttattactctcagactattttttttctttgaccagttgttctcttcgtcaaagacctctctccctaggttagcgagtgtgagaatgtggtaagatttgttgggtaacatctctgttggttaaggttagtggggaacaacccacatttcctggtgcaattcctataaaaaatgtgatatgatattactagttcccaccttttcccaaacttgtcccagagcttctcctttctaaaacccttattcccacactgttttcatgcattctgctcataaacacttcagtgagtgttaaccatataaattctttgctttgttccatctttggatgagaagattggttcagatgcttctttgtgcagtggagcaatggtgaataggcaagacttggtcgtatcttcagagaagattgcgagaaacccatgcacagagccagaattctattctcttaggacagcacccaacatgcttcaatccaggatttcctacaatttttctctagttctttgattgcttagatttctgattttagtaataattcagcaaataatctgctagaatagatctaagatcttgttttttcatattgcatctaagatctaagctccaatgagggtactaacatgatgtcactcttgctgtaaccatgtctggtgatgtagattgatgatagaattgccatttttgtacaatgacttgtcaagtttacttagcaaactgcacatctagctccattggaggttctaacatgatggcattcatcctgtgaccatgtctggtgatgtagattgacgatataattgccatttttataaaatgattcttgaagtttacctaggaaatttgagaaggggattcttagatctgacaccatgagattatagaaaatggttgcaaagattgcaagagtgtaattgtctgttaaatggggcatgcagatgatgtatcattacaatggcttataactatcatgtgtagcatgtgggtactgtaaataaaattccatatacatgtaatccaaggatacaagcttttagaaaactattagttgtctattttccattttgctatactttcattaaagcatgtacctcttgcagcaaaatacctctttagcacctgttcttttgtggataaatatcatgggatagttggtcaacttttttattgaccaacttactcatgttctcatacttttaaggatggataagttacttcctcatgggtagcatttacctatgaaatggaaaaaaatcttacccatctagggggtggctaaatcatttttccatcaatcgaaaaaataacctctgtaattcattcttaatatatctttaaccttataattataatataatatatcatatcatatcatattataataatatattatataaatattattagataataatataatataatatagaatattatattgtaatattataataaattattataatataatactatagcaatatattatattatattattatatataataatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattttgatttttgagtgtaggttgtcttgctcggttctgctccagatcctcgtatacaaaatgattttgttaatttggcaaatcaattgcattcttcgcattctgactgtgcacgcctttgtttaacctatgatgagcctctttcgcatttggtgagatttcaataaagttttagtgatgcttataccatgttacgcttagcaatacaaaatcttttacattctcatttccccttgttagatatatgccggtgcggacttcattcttgttccatcactttttgaaccatgtggcctaacccaacttattgctatgcgatatggctctatccctgttgtacgtaaaactggaggttagtgccttaaaagtccttttttttgggttttcttattctagttatcttagctatgcatcctgttcaggttcttgtgttgagtttctttctctttttttgagaacattgtatttcacagtatcatattaaaattctatcaaaagcccatgaaacagtggttgtgtccagatctgaattttgtggatggcttttcggatagagcaactgttcctactggtcttaataaccctttttttgtgtactctccctttctctcctagattccaccttaatgtaataatttcttaatatcttgcatgcataattttaatgtcatatttggcggagttgctggtccaataagcaatgagcaactccattggatgtggagtgatcatatgacatgcagatcagacaattgtcacaattccagcatccagttgactttgtggtgtcaaccaagattttaaaagctgataccaaacctcacacagttttcccaccaaaacaaaatggtatcgggttacgggactggtgttgacagtatgtttggaaactgaaagtatcaaaaaggaatgaaaaatcatcagtatgcactgataggtcaggtatgatatcaccaatagacaccggtatgaactcatactgaccgatgcatacctgtatgggtggttttagaatcttggctcttatactaatgtcagtttcatatactaatggcatgatactctgctgttcccattctggtggttttcatatccattgtgtcaagtgtcaactgttggatcacatatctaatttgttagtgcttttcttggatgttcagaaatgctgtaaagaattccaggcaacaaattttactgggacattatgcttttctaaaaccattaggcattgaattgtgagaaaaatcatgattttaacatagataattacagatatggccatgatttagtagattgtttgtgtagggcgtattggatttgatgtaaatatgccttattacttgcctattctgacatgtggtacagcaccagtggctagttatgagaatatggatatttttcttgtttgctcatttgaagattctaaggtccttgacacaattaatggtattaagtatactgtcagtttagtttgtattggctttgatgtaacttggccttaagaatcaagacccaagtaccagcgtagcatgtgacaaagcataagttgctaattcttagaatgtgggtgttgctctgatgagttatgatatcttaatatggtaaacaaagaaaaaggatgttagaccagactaagcagtttgtgaacttcctttatttcctcttttctctctttcccttctgtccgatttttattaataatttattcagtatttaatcagtttactcttcttatattttctctcttttacttgctgattctctaaagggaaaagcctctcatctgttttctatcatgaagcctttaaaaatgatctgttgtctataatctctttttctctctagtttatttcgagttcttctatatgttttcctaatatagctaagagatcactggaattgattaatgaacgtaagccacttttttcatgcttctctttgatctctagatcttatgcagatttatgtattccagtcattttataattctctagttactatttctcacatataggcatattagatttgaggataagaggtcaccctttgcattttgcaggactctatgacactgttttcgatgtagacaatgataaacaaagagctcaggcacaaggtcttgaaccaaatgggtttagttttgatggagcagatcctggtggtgtagattatgctcttaacaggcaagtatcaggacttggtttaatatattgttgcatatttaatgctacaatatgtaattataattatgaatttcaaaatggatgactaagaaagtcttttgtaggtgataatgcagttcatatctgtttggtttatttttatgataattgctttatcattttaaaattaagatggtagattagcaaaatgtgttggaaactctgtttgacaatagtctatatttccattaagaacaactatttattgtacatgacaaagtatctaatactacagaagtattttgtttcctagataagtaatactggagaactctcgggaaccttaatgtggtcatgtctcgcaaatgtaacgaacctgaggatttttgtgatgcaaactattttctaatatgttatgcttccaaaaaatatcatctgaaaattaaaatctggaactgctaagcacagtaaaagaattctaaccaacttacaagcatagtgcgtggaaagtattcaatgcatgcaaattgctgaaagttaatattaatcaagtgtttgtgtgcaaattaagcatgagatcagaaaacaaatcattgaaaattgtgaattgttgaaggactcatgctgatggatttttattaatttgaaatgggacacttgcatgccgctaaatgacaatgttgcatctgggtccttgctgaaagttaatattaatcaagtgtttgtgtgcaaattaagcatgagatcagaaaacaaatcattgaaaattgcgaagagtgttgaaggactcatgctgatggatttttattaacttgaaatgggacacttgcatgccgctaaatgacaatgttgcttctgggtccttgctcttggattgcaacagttgctacttaattgagcaaacacatcctttcatgaatgacagaggagatgcgcagaccaaaggtttgccaaaaaaaatcaagttaagggtatgatgagcaggaaacttgagggataatttcagatcttccgaagcatgcaaaaccttttgtgtgtaggtacctttccagtatggtacagtgctgtatcacatgcaatatgcctgttgaaaccagcataacaaaaaggtgtataccgtgccaatacagactagtactatgagccacactggcaatagtaccttactggcatgttatcattcttaagatttttttttttggctaattataagataatatctgtttttagtgaaagatgaaaatgtcaaataaacaatttcactttattcgttaagggaattattgggtgtattttttttcagagcaatctctgcctggtatgatggtcgggagtggtttaactccttgtgtaagcgagttatggagcaagactggtcttggaaccgccctgctttggactatatggaactctaccatgcagcacggaagtaaaggcatgcaagaagaacgtatggtaagcgtgatgtaagcttatataattcttgacagtatccttgtacagtcttttggtcttctgattcattttttttagttatataattagcaggactagcttctctattttcagcatatgtctcacctctcaataatgtacagagcaagagctcgaatgtttcaggcattttatgcattttggttgcattttaaattacagtcatataatgcaaatttgctgcttattatctcaggaaaattagcttatgcattttctccggcgtggttgaaatccttttaatatatgatgtccaacattatagttaaaaacgcccacggagtttgacaaaacttctgtaaaggcagtattatcatagagagactgcaaggatggctccaagttaaattgtccttatcaattcgataacctggcgctgatcgtgatgcatatctaaaagccataaagccatcagctctcttgtcacaaatttaacaagtatatgctcccttgggtaatgatgcaacgaaatctatgctttgctacagcttttgtatgagtggtctgaaatgcctattggtggcacaatggacaagactattttgcttgggcatatccagtgtgatgaggatttctccttggcctattcagagtttgatggaattttaatttatctaatggatctcatcaagataattaggctgtgcatcttctaataattgcaattgtaaactgatggttcgaccagctttatgcctttatcccacattgatggcactcttctctacctcggagaggtctagggtttaaaccaccatatttctcaaaatacaatcttacgctaacggagaattctaaattttcctatgctaatcgcttgttacgaaattcatggaaaagagaaaaaaatgctgttttttcatagaaagttattagatttctaaattcgttcactttctgatgaaataaattcaggaaaaatcagttttttttttaagaaaaaacattctctaagcaatttttcatgcaacaaaaggaaaggaattcctttcaccaatttctccacattaacaaggtgaggagataaagctaattcaaagctcggtaaaaataagtgaattttgttatacagggttcaagaaggacgttttaaatgaattctcttatttaaagctttcaagctgttgattttatgtgaatctagtggcttggggactataactaatttagatgttcaactttatataaaatgttgcccatggtattaagttggcaactataaatgcatgaaattacatatcagtccgaatcgatgagtacatcgtgtatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtctcctctaatcatgccttcccccttttccttccctctcctctctctctctctttcttctctcgattcgcctcattttctttgtgttggttcatctcagtccagtccgatatgtatccatatcgatctgtaccatcaatcgatcagcatgggcttcgatatcgagttcgcgaacattacctaaatgactcgataaatcggccttatcatcttgctctatgaatgaacctgaaatatggattgctaggtcttttccttcgatattagaccaaatatatgtttgttaaaaaagtttctaaacccaatggacaaccattgccacttaaagacatataatatgaaagaaactgcacatttgccaaagtttaattattgaaaatcttcatcaaaaccatcaagcccttgctcagatgatatcattcctcacctcttggccaagatgggagtctacctcttgttggattcacttgaaggatgaatggacacaggatagaatgtaagaattagcctctcctactcgtacatgcgcgcatgcatgtgcatatacatgcaaacacccattatcctcacgtacatgtgcatgtatctccataagtggcagtgtatggtgtgatgcatgatattcctctcaatttcttataacaagaaaattaatcaagcttaataatatcatcacaacaaatctccctaccatgtagaagtttaaaaacaacaattagtactcatcctgttaacaaaaggaaatgactaggaggaagattgagtagtgcctctccaatgccgttctagagatgacaagcacggaaaggaaggtgttgagaagagacaaatgtatcaaatgtagtttaatactctctcctgtgacaaagggaataaaaatgaactcgaacttgccgaaacaaacatgcatcttgcttactgaaaataaaccttgacacaatacgtatatgttgctgatcggaagattagatctgtccaattcaacacgctcaatcagagagactctaaacttgagcataggtgaatagatgtatagctaatgtaactgaggtgcttgttgttgcatgaaaatagagagcaggccataattgggttatgcatagaattgggttatgccctggatgtgatcacatatgaaaatatgggtaggcaaaatggatatcaccaccgttaggggtgtaaaaaaatttgattaaaccatctaaaccgtccaacccgatccaaatcgaaacaaatatgatgatttaactgattcggttcagttgaataaaatagaaaaatcgatatttcgatttagttattgatttattgatatatgtgatccattggaatcgaaccgacaaatcgaaattaaaatactatcattttatatatttatatatatatacctatattacatacttcatatatttatatatacacttatgttacatgcatattcaaaattagattatgtactttatatgaattaagaatctaaaatatttatttgatcctatttcaatccaatttagatcaaatttgatttaattataaataataataaaagaataaaaaataaaaattaaatcgatcaatctgcttaaatcagaaaatcgttcaaaccgttcaaatacttgaaaaagctatatgaataaatcgaatcgatagaaaatcgaaccgaagaaacagattatatttagtcaaatatttaattttagaaacttcttaaatcgaaatatcgatttagttttaaaaaattacttaaaatcgaatcaatcgaactatttttaatcctaatcactgtaaaattgagaattgagtgagaatatacggacaactagaagtatcaaatcatcgttgttaagttaaaatgatgagacctgtgatatcttaagctggtagtaaatgacaaatcttcaacaaaacaaaatctagtgcccttgaaatggatggccatgattaatttatgtgagcaacaagatgtatagatcaaagatgaaaaatgaaaaagtaaattattcagactcttcttgagatttggggtaattacgtgatcccaaccaacgttttaaaaatacacatgtagttttttagtcaaatataaaaatttaaaatataaaaaataaaaaattattaaaatataaaatataaaatattttaagattgaaatagattagatagtaataatgttaataagatcattagtttatttaacagaaagatattcatgatgaaattatgtgttatatatatatatatatatatagcaatgcttaggtggtagaatgtatatttttaaacagttggatgaggatctgcaactacctcaaacttcggaggaggatactgtaatatagttaaaataaaaacattcaatgctcctctcacgtggacctcgtgtgcaaaacgacggtacgttgtgtctgcggtggactctcaccggaatccactggtttctagtttctctctggttcgccgacagagggactgagagagagcacacacctactatctttttgcccaagaactccgttctcgaatctgcgagaaagaaaaattcgattttttttcccctatcagcaatggcgataaagacccccattggcgggctgaggctggcctccccgccctcggcctttctgcgagccccttccaagagggccaccgtcgcttgcccacccctccggacctccttctttaacggcggaggtatggatcccatctttgtgctggtttttcgatgcatcttggctctgatttcgatcccaccgccctgtttagaccactttgatggcgaacatggtgtaagccttttggtcggaactctgaaccacggctgaaaacaatcagcggcatctcatgctaatctttgatgtttacttgaatttttttatcgattaatggtgaatttttggaagggttcatgggagattgtattttgtttgatctgttgatttaaagctacatagatgatgattgagggttcttgagagtaaaaacttattataaagatgaaattttgaaaaaaaaaaactttccttctggcatgttttggaatttagggtagattatgctgtactggctgaaggagcggcataaattatctggacttgttattgtatacaccacggtttgccattgtggattctagacgtgtttttccggtattcactgaattttttagttcaacaagtggtcgcgatatagatgtttgtacaatttcttttgttgcaacgttttctttctttgtcaaggccatatggaacttcttgtttttatgctttacagtgggtgctttaaaagctgtagagattcgaacatccaggtttaacagacagagatgtggtgggcttcgtggaggtggtcttggtgcccagatgaacctatttgatcggctgggtagggtaatcaaggtgagatttaaagacaaaatattcgacgatgtcattttatgatatcaattgctaattccttctgattctttcaactaattaatatcgtttggtaatcctattgcatgtgtagtcctatgtaaatgccatcataagttcttttgaagatccagaaaaaatattggaacaagctgtaatcgacatgaacaatgacttgacaaagatgcgccaagccactgctcaggtttgacttttagtacctccttgatatcagcaagtatatatcttgcatatagtggagaaaaatactaatctggccctgatctacactttcatgcttacaccagtctgccattttttattcttttctttttgtatgtaatcttttcacatcattcttctatgttcaaggtattagcatcccagaagcgtttggagaacaaatataaagctgcacagcaagcttctgatgattggtaataccatgtttgagatactactttcctacaaagttgatatgtgtgaataaaacctttaactggcagcttaagttttattaacaggtatcgtagggcacaacttgctctggcaaaaggagatgaggatcttgctcgtgaggcccttaagaggcgtaaatcttatgctgtaggtattttttttagacgttaataaaccataattttgaaagcattgctattgttattatttattttcatcttcagggaaagcctttgttgtaaactcaattgcattgctaaaatgtagtggtatatcagtttcaacatagccttcttaaatggtctgtcactgcaataaattgaagaataaggagaaaatagaggacaaagcattaatagtgtaagctactggtagtctgatggtctccatttgcaaatagatagaaggtagtctctatattaaattggttctacaactgtctctgagaagtgatagtttttattcctacaatcagcttttgctttgaaactgtaagctatcttttctctctggatcaattgcacataggacaattactttgagagttttagggtcaagtgagggtcacccccttcattttttatattttattcaacttccttaacacatgtttgagagagttgacgttaatttttcgtctgatgattcaagtgtaagtagcatttagaccatctaatcctgatacaatatgtcaattgtatcttaatttcttgggatatgccttggtcagtcaaaaattttgaaataccagttggtttttgatcatggagagtgttattaaagaccaagaataaaccagcaagaggtgaaaacattttaagacatgcagaagggaaatggagaatacgctgaaacaagaaggctaaataaaagcaaaatataaatggagatcgtacgaaaagaaaaggccaaataatagacaaaatattcttgtttcatacttgcatcaacagacatattatataaagaaaggagttttccaaagctgagagcatgtatcgagaaatacctggagactatttcttgtcttcccagcacgaatggctgtgatttccaccagattaaagttctatagatgtgcactttctgtttttgtagcaaaattaaggtgtagatttgtaatgggcatgattgtgcataatttatccatgtgctaaacataaagaactatacatacatgcaaaaaatcctttttgggggattacattctgattaaatatatctgttatatacatgtattttaacttagctgtatctgagtggtcggtaaatattgatttatggagtcaggatctttcagcaaccacatttatatatagtttctttctttctttctttctttttcttttttctttctttctttttttttttggttgcctctattagtcacttgtgtgggagattttgctcttttagtagaatgcaggtagtgtaatatagaagttaatgatattggcaaaatcagatgaccctagagatagacctaatcattgaactacataacttatattcttaagttctgtcttattttaataaactaaaaatttaagatggtttaaggcattattgacaagttacaatactttcaaagtctattgtaacttgtaaatatatactaaactcatttatgaacaataattgaagcattgaatattcatcattattttaagctcaaatggcagagacagctggaattcaattgtacaatttggtggagactcgagcttgggtgcagggattgaaatgaaaaaccttttgtagtaaattatttaacactttagctaggaaattcccaagagacaaatgttgtttgcttctagtgtaatgaaattctttgggatccgatatgacaaacctcattgcttatagaaaaatgttacaagaaaatgctttctgcacaaacacacacacatacatacatacacacacacacacacacatacatacatacacacacacacatacacacacacacacacacacacatatatgtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacacacacacacacacacacacacacacacacacacacatatatatatatatatatatacacacacacacaatatgtgtatatatatatgtatatatacacatatacatatataaagtacatatttatgtgtgcctgtgcaagtgcttgtgcttttatatgcattcatcctgtgcgaccacctatggtatagttagtataatttgtggtgataaataggaacactactcctttactattttgtctgaaatttaacattaattcccctttttcttttaactgttgaggttctaattactttaattaaacctttttttatctaggataatgcaagctcgctaaaagctcagcttgatcagcagaaaggtgtggttgataatctcgtatccaatacccgggtgagcatactatctttgcgaggccatattattattgtagttccttttacctgttaatgctttactctgatgaggcacatttgtcacctcaaactatgttctttctctgattttctctttaatacttagaaactatttttactgcaatcacccaatgatgtcttgatatttatgacagtgatatatttttaaaatctttactttaatatttggtagcatgttctctttctaggtaaaaatggtcaagttatttagagactgaagtttgaataaggaaaaatacgccttaacaaactgacaatttggacaatgaggatgaaaatagggattgacttgcccaacttccataggtcgaacatgctgcccatctgctttgagagagagctacatgttctttatatcatcagctatgaaagaaagcgaaaaaagtctttcatagccaatattttagatactctagctatcgataattccttagatgagcttttgaagtaccttttggaaaaaatagaagaactccaaaagcacttcaactggggtcagcatagaaagtttgtgctttatgactaaagcacaaaaagagaggctttattcagtgcgatgggagtttggtaggaggggtggtaacaacaattagttctataatttcagagagagagagagagagaattgtcatataacctatttgaagccaccacaggtatgcgaatgatgcataattatttccgcattagaggagtagctgcaccttaactttttgtaatggatgcaacatttgcatatctaagcatggcattttggtttctttgtaagataattttggagaatactttggttgaaactgacgagtttcagagaaaataaagaatgtatacttttggttaacttgtgtaagatagtattctgagggcaggtttgtgttcttattttattctattgaagttttggatctagtcagactgacttcatattcttcgatctcctatctattttagttactggttgtgagaggatttaaagtcattgtgtcctggttctataaaatgttaggtgtcttttacatttggctccatgaagaacaaaatttatttattttcctttatccttaattccttattattgtgttcgaaatttctatacaaaacaagttaacatcttttagtccaaggtttaagcctttacttctctcttcaggtaaaaaggttctttatttaactatctattttagtttcagttgccatgcaagattaagggcagtttagatacttcgtttctttgttcaaatttgaaatttatactccaaatagggttgctatatagactaggttttcctacattaaggtatcttggtgaaataggaatcactaagttttttattcatattttaatctttgaatttacttgaagggttatcaccgagtagtttttgatgagataggtaatatttagcatttgaatcctttaattgggaagatcttgaagtcaataggattaagttttgaaaatttaagtttccccatgcatgggtttctattggaccaaactttgtaagttcttcctttttatatttatgttttatctttttgcaagtctctttacacaaaggtccaaattccattatactgagtcataataggagcatcacttgtttccttgagaaaaggtggttcttttggttcgtgttttttttgctcctttggctacagtcatccatgagtacgtgactcactgctttattggcaaaggccctttctttcatgcttggcatggcaagtgctagccgatcttatgtctagtctatcatctagagcaaagcttcaaaggcaaattgatcagtagccccataaataaaaaaaggaaagaaagtaccagcaaccttctcaccaatgtttaaaaaatcgataccggtgactgtctcgatcaccagccgattcagtacggtaccgaaccggtaccatacctatacggtacggcggcgtgccggtacggtaccgaaccatttccatacctacacatggtatggcggtgtgccggtcaaattggcacgccaaatttttttggcttttttttgcatggaaggtgtccaatcaagtttttataaattattaaataatttaaaatttaaaataatatttagtgatattcattaatgtctgtatcactctgatacatttttaatcgcatgtgacatgaatctaagcatgacattatgttatctagcatcctaaataatcaaccatggactagatattattagattctaaaatacttaaattaattaaaaaatctaaaaatactcaatacgtattgatcatcagaatctggtcaatcgtcgatgtccataaatagtagaattatctacatagtcaggagaaacatcagtccatccttttagctacatagcattataatcgtttgtgttcattccataaggtagatgcattggattataactcatctttgatccctcactgagatcctgactctgagagctatcattgggttgatagcctgatcgtgaagggatccatccaaatatatcggcagcaaagttcgatccataagacgctccgaattgcacaggatagtagccactagaagatgatgtctccgatgcaccatatccatatccgtaaggatcataggctgcctatggctgcggataagagaatccagaatataagaacaaacctgatacatctatggatcctattctacgtgcaaggtcatctgtagctgcattatatcctgaacaaccttgcagagcccgtcgtttttatgaaatcgtatcgtcatggattctactagcttgtacactgtggtccctatcctgcgtggtgtgcgtaaactgaaactcaccagtgaataaaaaatcaccaaccggctgcatctcctatcctccgatccctctatgatcaccagatccatgagtagttgaagaactatcatcactgctctgtctagtgttcgaattcgagtgaaccgaatgcttactctctattggagttgcaactatcttttcttttcttgtctctgtgcctggcagttgtctgtcctctcatcataccttgctctggctgcaagggtggatgctgtggcatatcggttggaggtctatgtagaatgttgctacttacctactgagaggcgtccaccccaatcttagtagcaataaaactggcaggtcgtggagacgattctggctcatcaagctctgactcctgctactgactcataatccatccgatcatcggatcttcatcttcattaataaaatcactcgtagttggatctgagtacttcagctgaacttccttctcaatacatttgagcctcagcctcaaattataatgcacgtacacaagatcattatggcattcctattttagacggttcctctgtttgctatggataaggacaaaggtcgatcagttatgctcacatccacttgatgaaactgtctggaagaggatcttgatggcaaagtctttcaaatttcatgcgaatccaccaaaatgcacccatcattcagctgtaaaatcattgaaatttagcaaaatcaaaaagatgattgaatatatcaatatgataatatatttattaatatatatttggattcatctttgatttgtttcggatcgctgcattacttccaaataattctgtgccctccttaaatatttttgtctgtaaaaaaattatttgttataaaatcttagctgttgaagatacagctaagttaataaatatcattgaacttaacttgttcaagatatatagctgcggtgttcatatcaggctccatcttatctattatatttcgtagggaggacaaaaactcttcacccatgccaataccaggtatggagtactggaatctcggatttagataataagctgcacaagtgcacatggattttcataattgattaagtttatttatacagattttgaaagagtttttgatttgctgcttacctgctaaatgtaactctttatccatttgatagctccatcgatggtcgatgatcttgatgtacttatcagcatgctgtggatctgccatcttgatttgttactttgccctctccatcatataatacaagaagctgatctgggggtatcgcttgccatccacagtccgaagcacttcttatagaggcttgatagctgctactatcttcacgatctgctgattgtctcgtcactaagctctccacattgctcccctcagtgtttgtccttatatatctgctttgttgccactcaggactgacaaacatctgatgtagatatatctttttttttatcagactatcaagtgctatataattaatagcaaatcttgtgacatctctggtctcaatatatcatccctagcaaactgccgcataaatgataggaactaatatatgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcataattttgagaaatatatcttaaaaagtttaatccacgtatttcttgagtcttcctacgcttctcattgttagggagtaagaaacggagagcgagagcctaagaaatagagaagaagtcgaaaaacttcttttctatctcaacttatgttaaaagaaagccgaaccggatggttcggctcggttaaattgcgtatcgcccgattcacactggaaccgtccggttcaaggccgaatcgggtggttctctttctttctttttttttttgtggtcaggtgctgaaaactagggccaaactgatccggttcagtgccgatttggtttagcacgctttgaaccgggcggttcggtccgattttgaaaaccatgcttcttattaaatctataatacatctctactcaagtggttttttcttcttccattgtatgactccatgctttgagcaggtgacttcttccactctagtagtttgatgataaagtaagctatcgtctctttgttttttatattcttattatttttccaaacttatctactttctctttgatctttctactacttatctgaagatctccttgttgtattcaagtcttatctggctgttgtctatccccttagccatttctctttttttgatggttttcttccattggtagtttgatgtaccccataacatgtttgctcaaaggatttaagaaatttagaattttaaaagttatatcatgaatctatcaaagtccaatcaaaaagtttgaatttttttcatttttccctatgtccagagctacgcatatgtcttattatttttcttggaaatgtttcttccattaaaatgtaaggaaagagggggggagtgggggggcatcttttcccttctattcctctcaaaaaagaaaagaaatatttttcttaaaatgccattaggctggttcacttttaactgtattttaattgtgattttatgctataactaccataaatttcagctcggcatagtaaatctccaactagttattatgattgttgttgctagtacctttctacatcaattttggcatcaaggattcatgacaaaccttgtcaaactggcatcgcaggattgcagttattgctatctaacatgaacaatataagctttcctctttcaggtccagcttactccaatagggtcttacatcccttgggggttttcaattgactaatctgtccaaaaaatgtggactagcatgtgactagcatggtcagatacccagtgtcagtatggggtatctaccaagtaccgtttccctgccagtccatcgtctctttaggtattcaaaatattaacatttgtgagatacatggtttaaagtttcatcaggaactctgaaattgaatcttaagtttttagcttgagtcaaaagcaatgcaaaactagggtcggatttagaatttcagtcaaactaactaatggaccaaatttgttgtacatttacggttttcctttcatttatttattattgaatgtcagaatcacgttctttagaataaacttagaatttgtgagttttaagaatatctagatgtattgaacattagttttaaatttggaggaaaagtaaattttttgacatgactatcctaaggctcaaatatcacagacatgtaattttcatttgttatattgtgtttaaatgaaaacatgatattacaccatgaacaggattttaaccattttgattttttttttttgaatatcttttttgactggtgcagtctaagaccactaaacaaatgttctctaatatattatatcttggtttgtatgaattttctttatttttttttaatgttttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgttaaacaaattgttctcatcatgatgatataaaaccattgagccttttccagacaactttatatattatggattcacattcactaattattcttgttgaggcctatctcctacgttagtgcagtcttttcccagtaagctttaaaaaattggattattttaaaatcattatagaatcattggtgtttctttttaataatttgctgttggcacttagaaaatttctgtccattaagaagattccttccttgaaaggtagctattttacaatctctctctctctctctctcatgcgcacgtgtgcgcgcgcatccccttaaaggtgataatcttgatacccttataaaggtaatgtataattggagaaaattattgctgaaagaagcagacctaacaaatgaagactaacctgcctagtaggaagctataagtataatacaacaaagcatcatctattcctcaaatagaactaaaagggaaagtaacctgtgtactcacagagagaatagcttgacagccatgtacacatagagctcaataaaagtgtttgcagcccataaaaaatgtaaagtatcagtcatgggggaggagagcatctctgctgtaattggaaatccagctcattgtcatcctgaaaagtatatattttcctcgcaacacgttccatgcgctggattttttttttttgtcaaactctcattattcttttcattcatagtccctatcaacaaaaagaaagaatttgctgtatgtggaagattttaagccagttaattgtcatacagagtatctaaggcatggttgtcgtaccacgccgatgctcgatatgctgtttcataccatgctgaactatatactgacaatataataggatagtaccgctatgggatccggtactgagatggcaaaccttgatctaaggactttataaaagcaagatttgaaaattcatttcagttggccctatgcaatttcatcaattttgctggtttcaatatttgtacttcaagattcagagttttggttagaaaaaaggattaaaaaaatcaaagaaaggaaaaatagaagaactaaagaaaccaaggatagtcaatgtacaacattttacattagtttctgttatataggttctttacatgggtagtattatgtacaagtaatttcataaggtataccagattttctgtattataaatatattttatttagttattgaactttattttgagctatcataaagctttattttgtctggtatgctcaagtcttttattcatcaattatagtggaactcactgatatcttgaatttgagcggttgctgcatttctgtctcatgtcactaggttgattgggtacttaattaaatgcaagtagctacagaaaatcatagttgtgtcgcatttttttttttaaaaaaaaaaagatgccatgctcgtgagcggtggcatcttgtgtatacttatccacattagcctttttagagtgctgtagtagggcttttctagaggctaggcctaccaaaggttatatttatcatccatgtgtcaatatctgctcctttaactcaataagaaagagaaatgacccagagtttaagtaacctgtatatttaaggaaataaggaaatgactctgtatgatagtgagtattgatgtcatgcttaaaaagagcatttatgctactggctagtttcagtagtttggctgcaagtgactaatcactaaatcttctcagttccagtcaaaagcaatccaatttggcttcaaatctgtcaaaggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaatgcatagcaatgtttgcagctgatcacatcccctctctaagagggcaaaatactttctgaattttggaatgagaccctaacttgaaccctctatatggctgtttccacatcctgcaggcaaccctgaaaccaaggaatgctgatcagccatctcctcttgaatcctgtacatgatgcatgcccgatgaatatttattgtccttacccagaattttgtttccatagaccaagcaggcaaaatttttgatcttgagcagtgacagccttccaagcatacttgaagtatttctcacagctctgctggcatttaaggtttggtgggctgatttagtagaggagatatgtctattatcccattgccagagtaagtgtgctctgttccgcaatgatagggatcagaaacgagattatacagcacaacctttccagtagaaaactccagctgcctccaaagagaaatccttcacgcttccgtgggccagttttctatattccttgttcctaaaagcatcaaccaggcctggacagatctcaccatgtggaagttgcgaagatacctgtctctccagaacacaggcattagatgatgcagttagttaatggcactgctgatttagcatctctttccatccattgaaagcatagaaattgttggtagagagctgttttagatttggggaaaaaaaatgtcaaagaaattttacacagaaaactactcaagaatctttgcagaatgattatctttttaaatatatttctattctagagaaaactttgtaaatttatctcttttctttggtaagtttgattacaaggttacacaagattttttctcagtttgaatacactgggagacatagaggttatttgtatgtagtacattatcaatgtcttgatatctaatcatacactgtgtggcatctttgccccctttcaccattcatattaatggttcagcaattatgacccctcctcaagccccttacattcatattaatggcacagcaattatgacacctcttaagccccttacattcatattttcctttacatggcaatatatcttgttggcatcatatgaccgtcttttggcaatatgctttgataactgctatatgagttgaatatcttttgttagttgactgattttctgtttcatgtagcttttggagagcaagatacaggaagctaggtcaaagaaagatactctaaaagctcgtgctcagtcagcaaagtctgttcctatatatttttatatatgatatgaacttttcttataacggtaccttaaatgtttgaatacctttttaccataggactgcaacaaaagtgagtgaaatgttgggaaatgtcaatacaagtggtgctctttcagcatttgagaagatggaggaaaagggtatcctcttatgactcctttactagaactttctacatcacattttatataacttcttttattggtaaaatgatgtttgaacaatttaaggcttttttttttaaaatacacaaagaattttgtaattgtgctaaacatgatccactacttgaaggaggacctgaaattccttgtgtttcagttcacaacaatatatgcagcttcaaactcttgagtttggacatatacccatccaagactctattttcttgcttacacagtataggaaaatggactaggtcattttagcctggaccgcttcaagtttttctctatgaccctctcaggctagggaaatgtggcagaggttgggaaaatcaacttgtattttgcctgcatttgaaaatgctgggtaaattattttttttatttagatcagggtacctaatatttgatatacatcctccaatacattcattcgcttaaagagatgtacatatcaaaaatatgctggattatgagttttgtatttaaattggctttttggtagccttttggtgcatatcattaatcagttttctgatgatagataaaggtggaacgccaaactgattcgtgagtaccagaattagtatttttgctttttaagcatttatctggtgtatttcaattctgggtccttctatactgtcacttcccttcaccttcaaaagtttgcttaatgtctatgcataaattattctgtttgaaaagaaggggaggggaggggctttcatgtttatctgctagacaggacaatgctaatattttgtcccactggaatctattgattgggattgtgtctgactctttcttgacagttatggcaatggagtctcaagcagaggcccttaatcagttgacaactgatgacctagaaggaaaggtagcaaatatattattaatacaaatttagtctactttgtcatctggacaatatatctccaatctaaatcttgtttgtcttttgcagtttgcattgcttgaaagctcatcaatggatgatgatcttgtgaaaatgaaaagagaattgtcaggaagctctttggtatagtctactttggttaaatcatcaacaatattcatactttgtttattataatgcagaaaaactttattcaaatctttcatcagtgaagcatggtgttgatgttcaaaagcaattagatttgtgtgtgttccttttctatgcagtcctggaagtaagcatcaatatagttttcaacatttaggccttcattgtcttgtaagaaatgggtgcattttgactccactaagacccacatgtgcgcgtgcacacagagagaacacacaacacacacacacacacacccacacagagtatctagtttttaaagtgttacccttcctattcttagtgcttgttcacagaagtttcctcctggtgtttagaaacttagtaacaagaatcctccattaagagcagtgaacccttttccggaattactcagaattttctcctgcacccactttctaagtgttttcttactaaattttttcaagagacccacttcgccatacctggacccgcttctggtagctctgattcagaatgcttatccacaaataccatttatttgtttaggattatgtagcacactgtgtatttgccaacgccagctttttaatatttctacatttgtggttgatgcatatggcaaacatatgtttggtaaggaatgtggatactttaaataaaggttcacaatctcaatactgggccccttactggtactatcttggtacaatgttggtgccgggtgtggggtttggttcaacaaactgattctcgggatgcctactgtaccgatttggtgccaatatagtatgcaaatgaacaaaccgttacaacataccaagcttcaaatcacatgttgtgttcatattggctaaaatactctttagatatgcttccaatgcttgtgtcaagtatcctatttagtagaattaaaaaaacactcggtacttcctagactcacctgatattactctcctgatgctccaaagataaggagagctttttctctcttttctttcttcttttttctttccccagtgattaacctttcaatggtgaacggtcaattttggagtcagtaatttaacattaaaacatggagtgtggattggggtctatggatttgaatgctgattgaattataagcttataaaaagttgatgctattgtatggagaatggactatattattttagtagtctcattatttaagatgcttttttacatacatatatgtgcatatgtatgtcatatcagcttgtttgaatccctgtcatatctatggcccctgtccatgtgtatgcttcattgcatctgtctagattgtaaaccatattgttgcaagaatgcattcttccatgatcatgctatgattgtggtgatagtttaatcacatgctgccttcatgcattatgtcaaaaagttccatcagcatcatcgtgatcatgatcatcatcatgaaccgcaatatcattgagtaatctttcattgtgttacatctgtgatggtgggattttacggacaggataactgacagtttgaactatcatgtccaaaaattgctgattcagcctgtataccagcttgatgctgttacaccagttgcgtcttacccctccgtttttgcacatttgattatttaatctataaatacctgtggtgtcagtattagttcgatgtatagcactatcatctttaaatctggcagtaaaatttcaaccatgattttgaaaagtttacactgctcagattgcaaagtcatttttccatgtaatctttcagggaagttaatccagatctgttgtaaatgtttccattgaaattctaaagatgcagaacgttggaagaatctggtttctcatatatatcttattttctgtctacagagaggagaacttcctgctggtagaacggcagttagcagttcaaaggcaacatttcctttccaagacatggagattgagaatgagctcaatgaattgcgaagaaaagccaaggactattaaagcttccggcagctgttttgcaggaagtccgccttatcacttcatcttagtaaattcagacactttttatatagtaccagagcattttattatgatggttgaaaagaacaaatcggagtatctctgagattatgaatccatgctctattgagcggactattcttgacgcatcaaggatcgtgccttggtatgtattcagtagcagcatgtttgtaaaaaaaattagtcaaatatgatactcctttcttcttttcacctaattatacacatcaaatgtacttacacattatgcatggtggactttttggaaaatctgcctttgttattaactaggattttgtgcggtaagttttgcacctcaaggggctatttggatgatcctgtgcaatccaacaagatcataggaccacataccagtgacaggcatatgctcgttggaactcccgggtatagctttggagtgggcccccttttttttccttgaatttttcaccctgcagtaataggctagggtccaggcaaggtccagttaatatgggctgggctagatcgtatagtttgcaacactagaaatcatgtttccaattgcgaggatccaataggattattatctaatttggccctaagctgtaaaatactcttctactagtgctcaaagatctttgttaccttctctccccatcgttgcctttgatatcatggtcttgacttttgactacctcttccaaacatgtaaactaaatcaagcttatagtctcgttctctagcatatgaactggcaatcagcttcatctaagcgtttgtcaatttgtaagtgggaaatattatatgtggatggtatgagagtaatggaagttaaaatgttagattggttggtcaaagatcacatgggaagaattaggcgtactggtaaaagttaaggaccccgattttttatattattgactgcctatactgcgagtgctatatcaaacacaaatttcatgcaaaagatacgcctatccaaaccatcaactatcaataggttgcaggcatgaagatgatgagagcactaatcataaaaacacaaatttcaaacaatccattatatcgtatgatggcaaattgcatgatctttggccgaaacaaatttcctcaagatatagatatatatagacacacacacacacacacacacattcaaaaaggcaattcaattacaaaaagttttgaaaatcgaatgctccatgaccactgtttttgtatttgtgttaacctcatcggagcagcagccaccaaaaggagtctgtcaagccactacgacttcacatgatcaagagtgctaagaaattctaccaggatttgcacaaatttccttcatctgctttaggtccaatcatgttcccattatcaagatttctgacaatccctatcagcgcttctggaaacggaagtgtatttttttcgttgtgtgtgtgtgtgataaatatgatattataataaatatgaagaagcgtatcctgtcatttattatgttcacagattacatgtttagtacattaagaaagctgaaaaagtcatcaagaagatgcctaatgatgttaaaatgcgtgacattcaacctttcagactagactaaatctatgatttggctcatttcgtgtcaacttgtgattcttagatggtttgacaaattaggttattatgcttgcgtcacgaattagattactatgctctcttcattggttgtatcctcttcagaatgtgtagtagtgatgtcttagttgtctttttatgagagggaaaaaacctattttggtattgaacgaagaaaaagggagtaatctgtaacaattttcaaaaatttttaatttccctgtcaagaggttagctccggtctaggtccagagctgattgggatttgggaagtcaaaataatatgggaagtctctgcccaaagtccggaaaccaaccagctaaccattttgattgcatacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgataaaacttggcaaagctgctttaggttgagtctggccacagagaaataaaaatactaagaaataatattttgcccagcatttataatgaattgccaggcattagtttatatatatatattcttattcatggtagggttaggtaaagaattgctgctttgagaatcatgcttagaatggtcatttatgcatggacctgcaaacagatttgcttgcatatatcatacgccaaaatcatatgccatccagtaattctgccacagtaggaaccacttatttctctggttcactgcccagtcttcttcacatctattttttatcagcttctggtctctgggtctatgatgtagggcaaaatcagaaccattcatttgttgggttagcactcgggttgagttgttaatggcaaaggactgacaaacaagtcgtgttgctggattccagtacaataggagacctgcgttttttaaataagtctgccctctactactagatatcaaaacatttctcttttgcacatcccacaattcccgctacctctccaaatacattttaaaaagtgagaagcaaagaagatgcactcctgcaaagttaaaacacatttgccaatttgtataaatagtaaaaaaatataaaggatcatagtcatgcatacctcttgttaaatgcatgggacatgtcaaacgctagctgaaaatttgtctcaccaaaagcttccagagtagcacgcagtcaaggaacgccatcaataaattggaaaagtagctgcagcccaaaaacaaaacctttcagttagtcaaagctctctatatggtttgaacgatgacaaaatataattaaacatggcaatgggtatgagaagtaatatagatagctgtaattaccaagtatgatgcgcttgtggtccggatatgatcgtccaatgtacacagactgcttttctttgtgatgatcattcttatcattttggaaggcctactatttccctcctaaaagcaaaagaatgggatggaagggagaggggggttcaaatgaccaggcgtggcactccagtttagtattagaatgaagagaatgtcatccgacctccagtcgaaacttcatgctatgaactggttccaacacctgtctaccgaaacctgttcaaacttggttcttgagacaaactataagaggtgctgaggaatgtagccgctccctcccaccaccagcactggcttacttcctctcggtcattttctctctatccacaagaagatgaaatccactttaaaatggacttgtatatctatggttggatcatatttggatggtagtggttggatttaggggggtcatccgataaggttgcattgggttatagaagttagtgtatatcgaagtaaaaatattaggcacaagaaatgaaagtagtgtagaattgggatctccatggtcggacaagcagcatttgctcataacctacaaaaaataataacagaaatttgatgtaaaatagtaatgactttacatcaccaaaaaaaaaaagagagagagaaaagggatggtaacggcatagcatcctaccagagcactattccacattgtatgcaccaagaaattgggataaagacacaaaggacttatgtgctgaaaaatcctgtcagtgtatcagatttttttcagtccaactctaatcaaacaaggcaacatgcaattcttcagaaatgaaggtttagatctcacctctatcaaatattcacagtttacctcatgcccatgcaaaacagcaaacaagccaatattcacacagtttactccatgcccatgcaaaacagcaagaaaaaaggaataataatgagcatttctgagattttcatccagtaaaacatacagggatttcaaacaggtaaggtctgctgtccatcaaaactaacagaagaataagaagtgtctcaaagtgggggttttgcaagcttcggcttcttcggcaattcaggcttttttgatgatcctggcttctgtcggaccttggcagtccttttcttgtcccttctttccctcttcttcaatccattcatatgagctttagggaccactgcataagaatcttggaatttttggtgatccttcacagagagctaaatcatgcatttcaataaagcaaaagcacgtgatcaaccattacttgaatttaagatatacttttcctgtatgcattccaaattttaactatctaaaggaaaactacgaaatattaagactattgcaactatctgcaagtgaaacattaataaaagatgacagttttgaaagaaaaatttataaagaaatgtcaaatatacctagaaagaatttcagggaaaaaaatgctgacctgaacccactgcttctaacctaaagttcaagggggtcaagtcctgcaatctaatgaggccaatgaaatttatcctccgagcccactataccatatatcaccctgatatcaaagccagactgcagttaatggtactatgctcctgatcatgcaattgccagacagcatgatgatggcagactccaaaatcacaactgtagcaacaacaatcagcaagctatagaactgaagaattttttctttaaaaaaaaaaaaagccactcagatgggatctttcctttcaactacaaccaatacacttctggaacaccatataatacacaagaagatcatgtcttgcttctctaatcagcaagaacaatcaaaatatcgcagtatgttttcttccatgtcttccttgtctcctatatttgggaatgaaagatttgatttttctgacataccacagttcctcaaatgccttgcaaaagccgccagacacccatgctgtttgaatgttcaatgcaggggcaaagcctttaccaaatatcatcctagcagaaggttcactaggcttcacagaatctcatgaaacaactcaaggctgagaaagaagtaactaacttggtgacgagtacaatcaacactttataagcagatatcccaatcatatgagaattatcttttggcactgaccaaagtaaacagcaaatttgtattttcctagatataaaagataagaattatagtatcttacagttagagcaggaaacctaaaaaatcaatctccatatcctttatccatcttttcgaagagaaaagtggtctctattatataaaaaatctgagtgggacaaacatgttttagttgattggcctagaaaagtgaaacaaaagcaaaaagcattggtattttcccgttttgtcttattacatacaagtttgattcagttttcagatgtatacaactagaatccatccatatatcacaggaaaataactataaaatacaacttataattagattagacattactctcaacatcccatcatatcgacctaatgctgtagactaagcatgcatgcaaaagatacacgatagaagtttttttatccgatctccaacctaatccatgctcgaattttatcttttgaactggctagctcccaaaataaaaaattaattaaccattgatttggtcagataagtgcataataaaattaaatttgcttgatcaaacctcaatggaatttcttagacatataccaaataataatcaaatagtcatatacataatatgtatacaccctgacatgtttgctttgcttctagctaaccgaaaagtgacatgaatcatgccaattgaagttggtacaaatattcacaacaagaaggaaatatgctaataaggatttcaaaccatttttaaatcccccacactttcaacattgtagctgatgtgtttcttgttaatttccggcaaatatcacattaccattgcttaggctcgccttcaagattttaacgctcgtcttcctattctcaattaattactttccgaaaactaatacaacaaaatataaattctaaacatatggaaaattgagaagttaaagaaagtgaaatttttggatggttaaaaactatgtttagatcaatctcatctagcagacatattgaaggtaattataggcagtattttgaccttttaggtgaaaattattattttgatcttgacttctaaactttttatactatttctaatcatttttttgttcgaaagaatatcttaatgtttttgcaatcacctctatcacaaaaccaaactatagaaagcaaggctttgatctcacaatggtagtctgagaatcaaatcaaataacaaaaataaaaaagcaagaaaggagggaaggaaatgtgattactcacataacaaggtgccgactaggaggcagagttaagggctgcaaggaggtcttgcttattccagcctaagccaatgacacccaagctgttgggtttagaggacttaaccttgaggtcattagtttgtatgagtgttgagacatttcactatctatcatatgtctataatttaccgggtcgaatgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctttatatttttggagattctaaatcactgtaaattcattttcatcggcaacatcaaaaattggactcctattaatcattctttatgggagcagtgaagagattaatgaaagggaaaaggccttctctcctcttctatcaggtaacttcttttctaatttctagtaatgcaaattattttcgaaggatgctagacatcattctataaggatgaccaaagcagattgtatttgcttttaggagtactatagataagataagcattaattaacacaagcacagattgcagacacaaatgaatattgtttacaaaactggtgcattttatacttgtaaactgcagtaactttgatgttgcatccacttcatatatgtattgacatgtgtgtattagatgtcatattttaataattgtctaaatttcttcttttcttttaataattctctaactttcttcttttcttcagactttaaattttgtcagttttcaggtcttaatctgtacacaaagttggatgtttgactcaaatagatagaaaactgctttcatctaatcctgaaccaatgcactctatctcctgaaagaggttgcgtatgatctatatgaatttgagtgttgtgtcaagatctcaaccagaagcacacattctaaagtcagctaatgatgaaattgtgtccaagacagctttaggcaagagaggagcctgctaacaaacaaagctaccagagcatcagaaacctgcccttcaagctcatgcaatatcctgtcaatagtaatttttcatttcatcattcatttgctgagctatttttttcttatttctgtattcagaaaagtatcatcctcatcatattttggtcaatcaggtcaaaacaattgacacctgtaaaaattgccaagtatcaaaggtctgaaagagtctggcattccattctctaaactagcctaacaatgagacactgtgacacaataaagttatctagccataatcatattcatcaagcctcgtgccaattaatatagggtcaggtttatgcatcttatccacaagattaatattgagggctgctgcccctgatgttaagtcaagcttattcgtgccctttctcaaatctttcatccatggtaccaaaggccttcacctcctcttcctacattcttgagcaaaaacttgcctcttcttatagagcctcttcagatctttgttgcacatgtccatactctctaaaatgagtttccatcactttagccttaatttatgcagctcctgtgattcctctagaatagctcatttcttgcttgatgcatcttggttttaccaccacatccatctctacattcttatttctgctacattgaacttgttttgctggaccctttttattggccatctttctaaaccatacaacattagaagccctgtggccattctataaaatcttcagctaagtagccaaggcatacatcaatcacatgacaccccagaagtacatcttaagttcaaccaaccaggttatgttctattacttatcttcatctatcgcttcacatattcatataaatcatcacattcatctattacttaacttggggatttgtgaagtcatctgcatgtaacatcaaatttgcacataaaaacaaatttcacaagattctcataattcaactatacctactagcacaaactttaaaaacaagtttctgatgcccactactgatattcttcagaaggctcgataatagttagcaccatttagctgtaaaaagttagtccatactctgatatgatataatcacattctatcaggactattaatttttaagaaaccaatcagaagaaacaaaaaaggtggaggttattgtggagcatgaaaaactaaaaaatttctaaaaaaaaataaaagaatggtctgatcataaagaacctgcataagttgctttgtacaataaaatgaccatatagaagaagataaacaacagaaacaaatatgtaagcacatatatcccacaatctggtatcagaaaaagtattaagaaaagaggtgaaaatatgaggaagattgattagctgcaacctactgaagtggtgatggtttttctgccatcagtagcacgaacaaggcatctatattcctttgcttctccttcagtctccattttcttacgctttgccttgctttcatagatgctaatatatcagagaagcaaagacttagtagaggctgaaaaaaaaatacaaaacccatcgcaaatatatgaatgggaaaaaaaaactcacagcccttgagggtgacccagacagagcccttatctttgctccactcacgcatacttgtaacctcgttgagaatgggtctggctgtagatgaacctgaaatgggagaaaaaatatgggaagtgaagtatcacatagcatgtaacattgcaacaaaacacaccaaaatatatagacatatagagcaagttaaagaatccattaagagcaaaacaagaaggcaaagagaccacagatttcttgaaaaattgaagaatgaagaacataccaagtaaaagagtcgtataataactttgaacaaataattgggaaaaaggaaaaacaaagactcctctatgcatcagcagttcacaaataaacaacgaactgccagaggattcttgctaagtttgatgaaggtaactaaaactcacaaaacgttcatgcttcttgccaattaaaaaagggaaaaagaaaaaaagaaaaaggaaaaagaacatggggacaagaaaaagcaaagaacacgtagaaaaggatgtctaaataccagacaagacaatgaggtagagaaaataaacaccaataccacaataagatttaggtccgtagagaaacttaaaagaatctgcaaaaaaaggaaagaactaaaaccctccttgcgctccagtaattaactacaacaagtaatcaagaaagcatggtaccgtctcgaatcaagatggtcgacagatataccaaagaactccgaatcctcagagatgatatcaaacgaaaatagcaccaaagaacaaacattaaaagaaccacagaagaataacaaaaagaaggaaaaggaaaaaaaggtcgatactatacaaaagaactccaaatcccacacagatatcattctctcaaatgcaaatagcatcgaagaacatagaataacagaaccacagaataattccaaaatcagacacagattcttgcgatcaaagacagatcgcatcaagaacacgacaaagaacaagaaatcgagaattctttgaaggaatttggctagaaacgagctaagtggatcgtataagaagtggagaatctcaccatatcgaaggaattcgatcgatcggtcgatctgtcgcttgaacggaggaggaagaggagaggcggaccaaatcgctttccgtcccctttcctattctttctgagaccctgcagggactcggaggcctccggaggcttttaaaagaagtcgcgcggtatgctctctcggtggagttggacacgtgccgtaatgtgggacctgtgggtcctgccaaccatttgatgtctagatgcactccaaatttttccaagtggactccttttccactgtcaacgcaaaaaggaatataaactaactgggggtatatattgaaaatgggatgccaattacatcgtatcaagccggctcaccgcgtctccggatagctgttggggatagaaagggagaggctctcagtccaattgggaaaaattagggttctcggatatcgctgccaagtccttgaaagcaaacttatggcattaatggcgatgaccacgatcggcccaagagttccatttcaacgaattagagctcctcgggtagtttttccttttttgttcccgaaattttgattagaatgaggagtcatgtgctttctttttctcaaaaaacccccatgtttagcgctcattgtgttgtctgtgtttttcttggctaaaaaagattcttttttggtcttgcctgctcgtttcttatgttcatttcgcatatctgaatcaattgaagacaacttttctagaattatgacttacaagaagtaattttaaatgatagagaggccaattacttgtctcgattacgcttgctatttcaattgacaattgatttataaccgatcatcgaagagtgatgagttcttctgcttgtgtatgtcatctattacgatgactgttttagttttcaagtttttgatgtagttaagaagaagctcatttatatagatatgcaattctggatttcaggtgatggttttgatgcgtgcagaaacaagtgtttctttcaataaaactgtcgataatgttgctattggtaatgcatgggaaggtccgtaccagaggtaaattccagattttattcactattagttactgggtatttcttctttttccgtttcatttctcccatctaacttaaaatgctaatgagtctccgacttccctggttaatggaattgtaggtagagttggtgatttctagaggatttgcatcattttgttttttttgttggtagcaactacttttaatagataatgactagatcacccataccatagcctccattctgatttccttttattcagtttcctaacatccagatagagccttcatatcaactcttgttgcttctgtgtcatgtggctctcctccaattttgtccaattcttttacagaaatttccttggttgttgactgggattttctttttctttggcccctaaaatttttctgtttttctttaagttgggatgttgggagctattttatttaattctacaaaatgttctcattttgcgttttatgggtttatttggctgaatattgattgatggtgtttctaggttttaaacaatgtattatcattttatgaaattcctactgaggtttaaaataccggcaccaaatcccgcactatctttccatcaaaatggtacgtatcactgcggtacaagtatcgatggtacatgctgaaactgactgattctaaaaatttaaaaaatgatcaatactgactagtgcaacaagtatggtaccacaagtgcagattggtatgaagtggtatggctggtacatacttgtagtgccaacacccataccaaaatcagttttgcacttgaatggtaccatctcgttttgggtttttgaaaccatgtttgtgactttttaagctgcaaaagcattatgcaataacttgttattatgttaggagtaggcagtgtcaacatatacgcaagcatgtaaggtgaaatacctctgtaatttagcagcatttatgctgctagaagctgatgatatttgataaggtcatcctgtttcttttttcttttgttttcttttaacatataatttagatcataactaggaagaatttaatgagaaacaattctattaaacggaggagtggtacaatttgaggttaaagggatggagaattggttgagatggtatatcatgtgcaaagaaaatctagggaagccctaattagaaaggatgctaaatctaagtcgaagagtgtgggaggaaaagaagaaaagcttaattatctagtagaatttattaataaggatttagaaaattttgaagaaataccaaaggtatatcttgatagcaattattgaaaaaaaaggcatataaagccaacttcaaatattagcataaaaattgatgcttatggttataattttgatagaatacatatgattatatttgcaataattggaagatggtttgatgcttatcataaatggaacattttttggataatttgtactttgttccctcctgcttttttttaggatgaagaatgaaccttgcttactgtttttattgatgagaattttcttgctgatgtaatatagaggtagatcttctcaattccatatatgattggcatgatggccatgattggatggattggggcctatgaaacatcataaggcttgccacccacgtattgcattggatccattcaatcatggccgctatgccgagtatggacagctttatcagatgagtagacctctctagtccatgtcaatactagagaggaccctagttataatatatgcccaatcatgtctacccctctgccttgctgttcttagtagctagggtggtggttgaggtcgaggttggagctaggatccctaaggagggttgcccatcatatctttcctcagccttgccattctgagcatctccaatcgaggacagggccaggactagggccttcaaggagccccctacatttgccaaatacgttggtaccttacccttgatcttctttcccctgaactcctttatcttcttcaaggggttttttgaggcaagtgcattgtttgccgatcccttgcttttgaacttcgccgaatctgctatagccatcaattaggacattcatattcataaataaaccaaattaaataaggacctgactttgcacatatatttggtagggcatgatatgcgagagctgagaggtctatccgttgtttgatttggcttatttttggatgtgaatttccttagaagtggctatggcaaaaccaaagaagctcaagaataagggattggtagccattgctcctactttgatagcatcttagaagaagacataagaaattcaagagcaagatgatcaagtgcaaggctgtaaagaattcggcaaatttgggatcctccttgcaggccccaaccctagccttatccttaattgccaccctaattgctaagaatagcaaagcgtaggcagatacgaaaggacagatattactttttggaattatgtgggtccgattatgatagggcatatattgcattagactaggtgacacacctcttgtttttcttgtgtttctgagttggactttctatatcggacttgatcctggctttcttctaatttaaagtaaaagattcatgtactaatgagagggaagtaattcattattttatatacaaatgaatcttgactttttttcctttcggttgacatagagaatgatcataaaacttcttcttctcttctcatattttcctggtcctttttagatgactgaagaatccatttggtctgcttagaaagtgtcctcatgatcctaaacaccttctcaaagtcccaactattccttctttccttctacttaatgaacaagatgaatttgccttggatcttcccatccataaaaagaaaaaaaaacatatacagatccccaaatatatagattctttttcatttagtttctagcttgttagcccaggctgatgccttttatttcttttcccagattgtagagggtctgcccttcttcttatcaagaaatatatatatatatatatatatatatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgtgtgtgtgtgtgtgtgtggacacacacccacacacatacgcgcacacacatgcatatgcacacacttaggtttgaagttataaatctttataatattgctaggggttgttgttttatgaattctttgagcttataggcaaggtggaattgagaacaaagatattgctaggatggattatttttgtgagcttgtataggcattcttgttaggtgctgaactccttttcccagtatccattataattgttgctctcctgtctctcttccttttgctgtaattgaaaatatgcagtacccttctttccttccttgactataggaatagatggggctgtgaaaatgtcatttggatggaagtggtaataaagaaaaaaagaaggtcaaattttgcatccaattgaaattgatgatgccataagtatttatttcacctttccttctttaaattaggttctgaccatagaagatacatgaatttcatgatatagcagttatgttgcatttattctataacaaagaaattcatggatgacagaaaatggatgtgccatggctatgtcatggtaagcaattttacgactatgggcagtaaaatcaattgcttccttctcttccacttgtttctagatgcagttatgtgcatctgtacagtctccaactgaatgaagctattcctttattatttccaggttattattttcttgtggaagagactatatgtctttgtcctggcccacatttgcgactggttcaggtgaactcgacctccgactcaactctgtagacttcattctccactaatgcaggttattggctataaatgaatagtaatgtgatatactgtttggtatatcaaattaactataaataatttatggttttaggtttagaagcatcaattacagatcaaaagaagaatgacttgtcattggacaacgttaagatagttgtcgagtcacgtgatgatgataagattcatgtgagcctgtcacctgaactcttgatttcagtaggcatgctaatgttcaacaatattgcattttccaaagttgccctattcatttccagacaatatgtttccagcaactttcattactctaaatagcaatcttctcctcatgtgtaatattgaatgctcaatttgcattacaactttcttgaagtatattgtgcttccttgtttgatagcatcttgatattttgctttactcaatgccaagttgctactcaggatattgctatctgaaaaatcattatacaaaggagattagtggataatgcttacatggagtggcatgtcggtcaattcctgtaacttggggtgattgtttggaaacagtgaagtgcataagtcgtctacaaaggaagatgcaattcaaattgctcgacatatctgacttgacagagttatgttagaaagcatactgaagcctctattcataaaactccagttttgtgtagatagaagatacattcaagaggtggatatcaagtgtatctctaccattgctggaaaaaatatatataaaaaaataatatatatatatatatatatataagcggcctggttatctcttatagaaatcagatatcatttttttggatgaggttcttttttgttctttctgtctactatgacatagttcattatcctattatcaggtaagagtggacttgactggagaggagacacaaaaggcatttgacgatattttgacaaatttggcccgtactgcaccacctattccagggtttcgtagaacgaaaggaggtaagattttatttgtaaaaggtaatttttggtagatatgctgtggcaacttccaatttgctataagctcgtgatttttatttttttattcaatgtatttgatctttttctccaagcatctagagatgatatgatttctacatgtccaaatttgtcaaagtctgactcaagattttttccccctcaatgttcgcgggatgactcaaggaaaaacaaccaatgtaagtgaactctgactatcatgtgcagttatttgttaccctatttgtgcctttggcttttaaatactcctgtatttgaacttctagaacgtggtaacatcctttaatactgtttgttgtttatgagcataagtttttctacaattgggaaataaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaaatcatcttctatagactggatcagaactcaaaagaaaaataaaaaaaatggagatgaaacttgttgtatcgatttttctcccaatgcttcttcgctgatattgaaaaaaaaaattcatttatttattttaactctttcaaaatatggaatatggtctgtaatttcgagaacaaagttcttgcaagtgtctataacaaataaaaatcctatccgaaaattgtccctctaaatttcatcaccccatttcgcaaatacttcagtgccaattttatgagtgagatgtccatctcatagaaactcaagttggcttttaggccaccaaatatgacattctttccattttttatctgggaatcctcttgtggtcaagttttggtgtcatgtaatcacaattctctggaatgactggatggtgaggggcattcttccttgataatgatgttaggctgtatgctatcaaactttgatggacaagcgtcatcctaaatagatgttcatatcctaatgttgaattacttgaattaatcactagctttccttcaattgtgtgccaaccatttttccagtaatttggctaatttttttcaaatatatagacttccacgtcttctttatcttccatgggatcttaaagatggttgggtggattacctctttgattctatgaagccccatcaagtgataacaataaaaatgaagtcagtgatagaagttatctgtgactagattgttgaatgatgatgattaagtttatgattgaggtgcatgtaccactgaatttttttttaaaaaaaatgatgcaggatgatgtggatcataatgtttgacatagtgtagcttaataatggcacatgaagtttcaccctttctgacagcctaactactggatttgtaaggatggtaccttggactacgtcacttagtccttcaagtcctcttaatatatatgaaaaagatgggtgttcctataaatacttaacactgaaggcacgacttgagagaatttattgtttgcatattatatacaatcttttaattacgtatgaagtttctaaaagaactgttatctttttctggtgttgtacctactagccatcatatcctataatgacttgtattcaagggtttaagaactgatcaaaaaaaatatatatatatatatatatatatattgattcgaaagttggcattatattttcttagaactctaaaatataataatttatattgatgataggatatttactacgattaacacgcacaaaatattttattttttaataaattattttttttgattatttttttttatttttcgagagaaagagaggagattatttctcttcttgtttcatggaatagagcatatggctctgaggaaagactgcttaatcttaaaattaggtgacagtgtcttttgatcggtgataaaaatgatgtttgtggttggcttacgataaaaattagtattatttatgatataatttatataatataattaaattttaattgagataagatcatattaaattattaattattaaatattttaattaaagatgtcatttgtgatggctagaaaggtgcatacttttctgttcctgaagtaatggtcgagaaagatgcctggacaaaagagagatcaaacaggccttgattgcagtacggcgtttttggtcaaaaatctagtatcctttttgacaatcaagttggagggtgtgtttttagactttcatcaagttgtatatggttattattttcccatgcaagtcattcttggggggcaacttggacgtcaaagggacatcgttgaatgaaagtaaagaggattgggggtatccttctggttcttctggtcatcattaatgtcctgagctatgaaatccaagcttatcaaaagtacatgctgcattgtgctttcatggagggttttaggattattttttttgacgtaagattttaggacctccttatgcttgattggatgatcttattggatcctcaaaattgaaaatagagtttataatgttatagagtataacatccggcctagcctataccaaccaaaccccttcctgtccattattttgcgatgggaaaaaaaaaatatatatatgaggtcatttttctttctatgagattcaaattggtttactctcaaaaaatttttaagaatgctacgaacataaatcctacctggccaatgtccttatgaattctattgaattgcattgaattattcaaatagaccatcaagttgttttgactattttcaatcttagaagatatctcccacacacgccacaccatatcagacgtgtatctttcgcaccaaagaatgattcatcttccttcatgcgaatccaccattggttcacccaccgcaatcctatgccccaagacttattccatggagaccttcttaatcactccccttaaatgatcagtcttaattgttgccttagtgcaagtggaactgtaattcatgtgatcaagcaagggacatttacttgcggaacaggatgctcttttccacaaccagtctcttctcttgccaatcacatggacagggtccctcctgcatcaactagaacaaaggtaacatcccttcaatttggctgccatgcaagaattaacttctcctgaaatcatggtttggagcttgatgaacatgatcaccaatagattaactcgaaaaaagagacctctaaataaatcatgtcaaattttgacgagcatatgaggaagactttcttatccatccatggcttatcccaatctcacatgcagggtaatgcatgtgaaacacttgtaatatcttagtcccaccaccttcggttttatctaccttgtcccctcctcttcttggcccaatgtcaactaattatttgagtattccgctttcccaagtttccaacctcccctgtatcttttttagttcatctcactcgctaattacgaggagaacctctaagattgatttgttccctctctcttgagtattggaaaatctcctcatcacacctctctctgtctctctctctcttttttccttcattctcaactaactcgagtactttttctcttcccaccttcctgaactaacttctctcgacttgtttattggccacccaacgtcttaattttgacttgttcccattagttaatgctaacttaaatgtcagaattttttaaaaaacatggccagcttgtattctttcttttttttttttttgtcaataattcctaatcatgttcattgggaccaagttgcccttctatatggagctttgaaagcctagttctcatatataattactgttgtattgtgattcgttgaaaccaatcaagtttgaattgaaagacttctatgtcaagattcctatttgaagtggtagaagaaacaataatagttcacctcaatttgataggcctgatcatggtccgtagtttggtcccaaattgtaccaaaaaccaaaccaagcttatggtcgcaagtaaattgaataaactcgaacatgtaaggacaactgacctaattgagtcccattagaacagataaaaaagttccattcatgtaaaacttagacctaacctagacttgacccaagggaggcccagcttggctcaacccacaggttcgggccggatccggctcaatatctggtccgagtcttgtccgagggaaccgatgaacaagacaggggaaacgtgtccggataacgaacggataacggaatccgatggcggacaagatatcatcaggcagggaggacagcgtgataaatgaaggataattgcgatatttcaacgccccgatgttgccagtactacccatcctcggcgtgtcggattagaaaaatgggtgggaatattggaattccaggttcagatgtgaacacctccgggtaaatatctgtccttgcgtccttgggattgacgaggcgaccaccgtatcccacccaataagagagggtaactattttccgttcccaaccccccaatcctctcaatctcaccaccctctgtaccccctttccttctaaatttaagcaagtcggtgtaataatgtggagtctcaactgcttcccccactctaacctggctggcttccaattaccccactccgtgcctcctatccttgatgccaatttacataactatcctttgaaatgcgtgctagtttctcatggttatttaattttatttatcaaaatatttaccacccggtcttctaatgaatatgatcctgggctagtaatgcaaccaagacaaatataacagctataaaattatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttgataagataaaaaaagtttaataataaaatatgattattaggaaatccataatccgctcatgggcaaaattgtcagatcggcaggctgaaaaaaaaagggtagttggggggcattttagtagtttcgcgcccaggctggtcctcttctcttttattcctctcgtttctaaacctccccatcccctgccattttcctctgttcctccgtccgaaacagagcacggcaacagcagacacccggaagagggagaaagatggttggagatttcatggtgtgcatggacaggatcatctcctctgcttgcttagaggctggtaatggcggtggtgggtacggtgctccaacggtcgatgttggtcggggcgaggaggggtcttccgagaagaaggctcagtctaagaagaagaagaagggtggagatgttatagagtgcaggatatgccaagaagaaggggaggagagcgagatggaagccccttgcgcttgtaatggcaccctcaaggtctccctatctcttcttccctccttactgccttcaattgcgctcttgttatcgcaaaaaaaaaaaagaaaaaagggaaaaaatttttcctagacttttttttaaatacaagtttcttcattttttttataaaaaaaaaagaaattgtggtagaaataagggaatgtctgcactacaagacgcacgttggtcttaatttttatctgcttcgaatggactgtttttgtgaatatttgcaaaaaatatatatttttaaatttatgatagtagtacattttcgctcttgggatatacaccatctcccttattttttatctggtgtagcaacgtgaaatttctgttttctttggattttttctgtgggatctgcattttttttgtgcgaatcctgcctgtgttttgtgtaaaaatggaatttttcttcccgattctgaatacattcttatgttttttgggtgcttatgatttataacaccaaagaatgtataatgtttcgggtgattgtattgcatgtcagtgtttccattttctctgtcacattggatgcttcctttcagttcttgtactaaaccttctcaaagtaatttatttggtgggttgtttttggcgtgtgtctgctgtaagttcgtttgcgttgtcccaaaaacataccgttaatgtttttctgtttttgtctttgtgagctgtttaaaatctgtctcatatcgggtagtcaattgtggttaattctttgaagtgtgtttaaaatgcttactgagatttgcataattttttgcattatggttttacgtttttgtgattcttgtaaatatagctgctttttcttttttggccattcatcctcctccagtttcattagttattactgttgcgttagttttccttgttggtcttttcttggctgttagagacctgattttatacccaaaattgttttatttggatgccagctatggtggattgctgtgactgattcttttggttccgcactttgtgaattgggattttgacaaacatttcaagttgtttcattcatttccttggtgtttttaagcaccaagggtacctgtacatctcttcctgattattcctttttaatgttgtgagatgcattttggggaaaatgtaaatgaacatgagctgtatattagagtttgttccaaagtgacattcggtgtgatcatctaaggacaaaggacagatagaacacacaaaaaggacttgaagttgcttaggggaggctcatatttgatgacaattattggcaacatataaaggaaattccaacattggaatttgagaaataatttgaaactaaatttgcattagctgggaaagtaaccagctgcggggaaaactagtgaaagtttttatgagccaatgactaaaaacatgcttgaatgttagttgttttcgatggttggtttttgaaattgaggatacatttggttttcagctggattttgtattaggggtgttatgatcttatatcaaagcctgatgacaaaattgactcaactcttgctgtatgttgttaggaattactgtttgcttaagccaaaagaattggcctttttgtagagttgtagataaggaaaatgccaaatggttaaagtaaaaaccataattcttccatatttatatgtagaatacttaggaccaataccattaactaaggaaaatgataatgatatttaatattgatgtggctattttacataggcgtggatgcaaaaattgattttggctgcattttaagtgttagattcttctacttcaaggatttcttcttgcattcatgttggatcatggcaacacacaagtaatctgggatgaactttacaggggttatcactttttgaaattgatttatcatctcataccttctctgagaattagtgatatagcttgtattggtgctgaattcactatcatatttctgcatgtataaatatttttatattgcaaatcactggtgttgcatttggggtttaaagttatggtgttatattttctaatttttttcttgagactagtaaaaatcctttatatgcataaatctatttattttgtggccatctttttctacaacttttttgatatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaacagagcattggctgttgatgtagccatgctgcgttaaagtttataggaacttttttgtttgtgaaattgttatcgtagtgagtgctttaattttctttgtagattgttatccattttttgacatcatatcgtttgtagtaatttgtgcattggctttatgtgccatttagtacctccaacaaaagtaagataggacccactaagttaagtatttcttattgaactgattctgctatactaattttttgatttcttaagttttgtttatagtggttgatcaacataatttatcttgttataagacaagaacatatattacagtttaaaaactatcgtaaaattttgattagctcttgtatcaatagagttcttacaaaagaatttttttttatttcttcaatttaacaggtttactcgcccgattattccctgcccccaaaaagagcttgttctgatgcaatggccattgatatcaggtattactgtatgacacctggttgtgttttcttgtttcccctgatcttcattcatcatttcactagaaaggtgtcttacgtatcgttcaactattacaactgtaacattcatgcttttctttttttttttctttcttattatgttcagtttcatgtatgctagtttgtttttgcagcctttgttggctaagcccacttaattctttccattttttcctttctctgtcatgagtgtggattctctgacttgaagagttactgatcatcctttgtttttatttttattttcagtgattttaaaattaaaagttcaaatggttttctgggatttactgttttaagatccatatggcatcctcccattactttatcgattattttatatgaaatcctgtggatatttgagttttgtcatagctactagggagctcctcacagggagaaatgaaagcattttacaggaattttgaagccattccagatctacactcataaatatctgttactttctaaaaagtacatgtaggtatcatgtgttcacaattttacgtcaatgaacttaatatcaaattaggggaataagaaaccatgttttgcttattaattttttgatattacttgtgaccttttactttctaatgcaggcaacctatagacgctagttgatctctatgaatatttgaattgaaactagttttaagatgtttttggctatgtatttgagatttgttcctttatgcttgttatgtatttgtagatactacatgtcatgtcctttgtcatgaagacctctgaacgtgtaatgtctcatgattccttttaggttaagttgtcattttatattttattcttgaaaactatggtttttgttgaattaatttgccatatagcagtcaagtaagaaattctgaaagttgatttagagatattggttttatgatatctgtaacctatgcattttgatctctctctctttctctctctcgtgcgtgcatgcatacatgtgcatgtttgacaatgtcaatgtcctattatgagcctgacttgaagatggcattgttcagcatatatctagggtttaattaaattttacttttgttaattctcttttctttttcattggaaaaagatcctttgtctactcattgtttcttcccaaactttattccagatcaagtttattctcttaaccatactgctattttattgttttcatgtctcttttaattaactttatgttttttagtcgtcttagatgtatctaatagattgaggtaatatgatgagagaagggatgaagggcttcatttcaggtcaaatccagcatgatctgaccaattccaatccatatttttagagacatgaggccgcctctcgacatgtgcattttactaggcatatgcttatttttcatgcaaaaagggcatcttaccaggcatatgcttatttttcacataaaaggggaagttcaaggcttcctatcttgctgagccaagggtttcctccttgagtttccataactcgattaaaaattataaacctcccacgcttcggttttgcattgaatgccagtgttaaaagttggacctaaatgtaaaatttagattctattgttaatgcttagtttttgcttggttatattttgcttggacttggaggttatatttttaacttatcaggtttcaggatatattttttgttttagtatccttaatgttttcatagtgaaagaatttagtcagatcatgctcttggaaaccttcaacttattcctttacaattgaaaattaccaggttcaagcctatttcagcataagctactaatagttctggcttcaatatttttatttacccttctatataaattgtttgtcttgattttgtttaatatatgatcctaaccttcttttctttccattgtcttgttagacaaagttggggcacacggattgatcttcatgattcccattttctagccattgctgctgcagagcaagagttgctacgtgtggaatatgaagattatgcagctgcaaataccagtggcattgcctgttgccgctctgttgcgctcattgtatgttctattggggttgggactttcttttgattttaatttgcttagcactatagaggcctgaagtctgtgatgttatacagttgatgctactgttgcttgttcgtcatattcacatggtcacaagggatgttggaatggtgcaggatgtatcagccttcttcaacgtaagatacatcttttggtgctttgaaagtttagagtatgcaaatattttaatatgttccatcaagttgtgtacgtacagttttgaactatgaggcaaatagctaaagttgtagtcagcgtttgccataccgtgcctaactggccggtacactccgtatcgtattggaccggcggagaaccggcacgattcggtcggtaaatttggtacaccggcggtatggaagaaaaaaagagaaaaagtgagaaaaagagagagagaggaggagagggagggaggtgggagccgctggagaccggcggtgtccggctgcagctgccggagggctttcgagccccgtatcgcccgatagggctttcaggagagtgagaaagagagagagagagcgctcaggggggaggaacctatcggactcgcgaggccttcggtggccgacgccgacggcttgagggcggtggtgcgggcggagccgcagggacttatcggacggacggtgcctccgtcgcgaggcctccggtggccggcgagccgacgccgacagcctgagggcggtggtgcgggcagagccctctgcggctccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcctgttctttgatatacaatgtgtgtaatcctcatcgatacttttgttcttctacacttgcaaactttgtttgacgaaatcggttgctaagcagaaaaaaaaatatgcagaccataagcattcttgtgagttacaagaaattttgggcgcaatgtcctaataaacaaaaatccttcaggctgtcgcattgatgaccacacaacagtactatcagcaatcagatccaacatactccacatcctagagctgactaactgcagataacaagaggtttgcatataagtagaacaaaggataaaaatgaaggcttgtgtacattgatttttaaaaaaagaaaaattgttttttccaagttccaatgtatgaatgatcttcgaagtctacataatcaatcaaaacaaaattccagcattcaacgagaattccaataataggacccccacttactaattggattataatatcacctcactgatccttaaaatcccgacactgaaaatgaccgagcttaacacaaaaacacctcccattcaattccacaatcgaattataaaaaaaatgcatgaaaccctagaatttcagcggatctgacaattctacaccaagactgcatttcgatgataaattcaacaagccaagaagctcgctgcaccgagttcgaaacaagaaagagagaggaagaggagtaaggatcggggagatcgataccttcgtccttgacgtactcggcgaaggtaccgcaatcggagcacagggcgagaccggtgaaccctaggttctcgcactccttcgcactgagccgctcgccgaccgccagcgcaggaccagataggaagaagaataggagagataggagggcggcggattggcccatctctctggagggtttctcgggaatgagcccagagacgaagtaaaagacgaacgccagaaactgtccttgggggtctatgacgaagaacggagactggggcacggcaattatcgctgtttgtattttagaaacgatggttggtaattatgcgttagcttggttgaatctcgtatatgacttcagagagagccagggttgtttggtactgttttcttaaaaaaataaaaaaataaaatttaatatagaaaatatatttacttactattttttatttttattttaaaaatattttttattatttaaaaaataaaataaaaatattattttttatttttaatgaattttcatctctctccttctaactccccttctttcattcgatcttatctttagcccctatccagccacatccattttttagggctcgtcgatcatcttttcatctaatatcaaataatctttcattcaaactaaattatcaattccatccttatttttttttctcgatcgctctctaatttagaatttttttttatgtcaaattttttttaatttttgaccatgttaccatcccattccttctctcatggttatcgctgatcactttatcaacccacaatgtgaaaaaaataaaaatataatgtataaaaaaaaataacatgaagtacaattatttctattcttctctccgactacgtttttaagaaaactataagttacttagaaaactctcaaaatatttgtggctactttcaagtctatttggatagagggggactcctccgttgttattcattaattgattggcttgttttaatgtcttgatatgggtatgtacatgttgaacacctagctatctcggatggtctgttgttatggcatgtaataaaattattttatcttaattataataaaaaattaaaatgttttatgatgcatattttgaaccgtagatgataatatataactggatgaacgatatgttatctatcttagaggtacacaggttttcttatctcccaacgtaatatctttgatacactagtcatatttggcatgcaagtgtaagggccaatgatccaaggattccggttgtatcctacgcgcgaaagggtgatttcttttgcaacattaatcgttgggttgcacttttaactaattttaaaatacgatgagatagatcataaagttaatattaccttttaaatattatgtaaaatacgacccaattgttgatattgtaaaagaaatataaatcattcctacgttccaaaagatgcagtgcaaacccatggtcaagatgggtgatggaccgccgatccaaatatatatcggatctaaataaaattaaaaaaaaaaaaggaaaaaaaaagggtttgggacgctcttctcgtcccaccgcgagcgtttcagcattgagagccactccgacagcaacgaggctatcccctggagctcgattgctcgtttcccctgtggatccctcgccaatggagctggaggactgcgagcggatgatgatggtgatggactcgtgcttgtcttgcatcaattggcgtctgcaatataggtcgaagcgtcggctcttgacaggtcgtctccttccttcttgcccttcttttcttcgttgttttggatctcctttcttgttaatatctctgatttatggtctttgattctgaatgtgatccactccttgaggaatagttcatttgggtgtttgttttttattggtgttttgttgattttgattccgttctgtgggtttttgggtggatttgggattcgagtcaagatggtatcttttgaacaaggtgttggcttaattcttttttctcaaccttcctttttagtatttcttgaattttctacttgattatgtatgcttctgggttatgattagagaaatgttcgtaacaaaataagtatcaatctgtcgaattccaccttcttccttgtacagaaagttttctttctcggttgctttcttatctttagtggttatatgcttctgggcgtgggcctggtgcaaactttctgcaaggacgttttccattccgatacttgatttttgctgcaaatttatagttactctgagacttgctgcaactatacgtgtgtttcttgtgtgatcaatacttggagcatcttgggaatgaaattagatcgtcttctaattaatgcgttggtaacttttgtttggtctgatcttcttttcttttttttcttttggatacgagggaggttaaaaccactcgaaagtttgattggttcgttgtaaatgttgggtacagtaaatgccccttttctttgatgatgtttaattgggactttgtattaatatatttttacgcttcttctgcttctttcccctctttgttcacgagaatatatgctactcagtcggattcaaacatctaaaagactgtcatttgtgtgtataattttcttatcatattgatttacttccaaactatagttcttgatagctttcctttatggggcattaccaaataagatggatctaggccttctggacaatatctcatgaactgatagcaatctttgtagcaatatgttgaaccacttaattttcgttttgcatgagacaactctagatttcctgtcttgttaattaacaagcaaatattttctttaagtttatctcggttatgtgtttgcatagaaagcaatacatgctattttcaatgtgatccaaccatttagaaaccatttggacagggcacttatgttccttttcattgaatctaatatgatttattagtacggggtaatttctaaacagcaggatatgctggggcattacacattcataactttcccatttattgcaaatctgtaacaactgactgcgaagatttttttttttttttacagacatactttgtttatgcactggactaagaccagtagttctggtggattatggtggactgatgccaaaactccaagaggacctctgcttactacttcgccttgcccaggaggttttcaccttggatagtcttcatctcaaactcagtaattttaatcttataaaatgttcatgcaaattatctactactgtctttatactgttctttttttttttctggttgatgctttccgtctttatctactacaatgattatggtgaaagactatatgagtattttatgctattgtcttatggaaatctcataggctttttagtgaagttgtattagatagtgaggaattcctttagttcaaatgatttggtatcttaaattgaaaaaggttaaaaatagtatgaacacaagaaatgccctcctgtagatttatggaagacaaaaagaaacatgtagattttttccttaaagcgtagatatcatgtaaatttggctttctttttttttttcctttttttttgtgagaaaagataaagtttcacctagttttcatgcaaaaacttgattgaggtgcactaataattaaaatcatgtcaagtaagctgatggattttcaattcttgggcttagaatagtgacaatgtcataactactcaaatattgctgaatagggatttttttttttttgtgaactgaatgagaaccttttaaggcttgcgtgtaacacacacgcacactaaatgagtagttacaattcaggatatggttttgatcaaactaaatgagtctggatttctggaatttcaatagtttcagctgcacattcagcaatttcatggttcaaatcaagggaaagtaaaagaaaaaaaatctcattgaaataagaggatatcttctataaatttgttattttttatttaatttacttgttttaatctaatcattcatttgtttacgggtaaaaccagaaaattgaatgtctatgggttcaaccagttaatcttagtgagtaagagagaaaggacaggatggagagagagagagagagagagagagagagagagagagagagaggagtagtaggtaggtaggtaggtagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagagagagagagaggcaggaaggatagtggtagagttggagggagagaaagatagagatagagagggtgagatagataatcagggaaaatgataaatgaagagagaacaagattgggggctgagggtgagagagtatgagttggaaacagagcaagggaaagagagagtgagagagtacgagatagaggtattatgagaaagagtgagcaagagaaagaaggaaaaagagcaaaatcccacaaatatggacttcttgagttagaaaaactcctgaatttgtgaagatttgagtacttagcaacttttaattggttacctctgaggtataataggtttcccccaggctggatatttgcatcaaaaagatgatgatttagggggaaaaaacaacatagaaagcaaaacttataaaataaaatagacattatttaaatagcatattatattatttgacatttagatgagttgtttcagtagttttgcaccaaaagaattaagaattaatgatctgttagagtattgtatttaaaagaaaaggcagtatatcattttaccatttgatgttcatcatcttatgatgatttaaatgcttgtcaggatatagttatatgttgaccagataaacatctggaaattcactttatatggccaaatatgcatctaagattttacttatataactttttttgccgcctaatattgcaacccttgcaatttttatcaaaaaaaaaaatcataaaaatctatgtttaatctaaagaaagtttttcctgtcatttataatgtacataactctatttacactatctgacccatgtagaattgtatccagcctacactccaaaattggttttggaaacagtagaaacttaaacatttaagtgccatttttggacttccaggagaaactccatgtatacaaggagagcactctggagaatgcttaacatgattgcaacttttgggctggttggtgataagctctgatttagtcttttattatacagagctaagatagaccaagtgctctattggagagggtagtgatggtccaagaaatctggtggcagcagcagtgcttatgtgctaaagactaaggtcttaaatctcatgggacagaggtgtcccggttttcctatagaatgggacgccccactgtctagtcttgtctcgattgcagtcctgatcatgcgatctaatagatatcctccatctctctcccctaattctttttttctttctttttcttctaccttcctttattttttctttctttccttacccctttctcttttttttcttttcttctttttcctctctttttcttcttctttttctctctttctttcatttttcttctttttctttcctttcactttttgcttttcttcttcttttcttttctctttcttcttctctccttgtgtagatgggtttcggagtcccaaccttgtcccagtcccgttttctcataggaacggatgggacggccgggacaccccctgtcccgctgggacataaaattttgctaaagaccacttggtccacttttggtagcatagtattaagataccggtatttgttttagtttagagaagccttgctgttattcttcgttattcctaaaggaaagaggtgacaaaaaactaggtaatacttatccatgagatagagtagatgttagaatttcagatgaaagaaaaagagaaatgtgtgcttttgtttgtgcactttctattgcgatgtgcgggtgggctgatgggatgcagagttgtattgcaggagaagataaaaatgtgaagattgtttctgactgaaatataagtagaatccttgtgaaaaaatccattgtaattttattgattttatgattcttatgcatgcctaaataccatataaagaaattgattttagttgttccaattagataactgcaaggatgtcatacacagaattaagcttagcaggcaaagaaataataaactaaacatttttttgttaaagctaagtaacatccatgctagaagatagttccccatttcagcattatacttgtgtcaatatttgttggtacaactttgtttcgtaattgaggtattttgtgttgagtgttgccttttctaattgtttgagccagcctcccttggttaaggattcccatggttggtatttgctaattgccataattctagttctttcaatctgaccttgtgatggatttgtcaatatttaatctttgtttcttacttctatgcatcgttctccgaaccatcctgaaccgtaccgatggaaaaccagtctggttccaacatacaaaacagcataggccgtctcagagggagcgagaagaaagagaggaagagagagtgggggagagaaggagagggagaggaagagagggcctcctgttgctgacttcaaccaaaattataaaaataaaataaaaaaatagcgaagtcggcaatccagttgctgacttcgcacgataaaagcaaaaaaaatacaaaataagattgaatccctgtttcgcacgagaggagggtagaggccctccttcagccttgaccgccctcaggtccttcggtggcctccagcgcctctcttcctctccctctccttctctcccccgtctctctcttcctctctttcttctctctcttctcttctctgtcttattgattcggcccagcacagaacgttacaaatctgtaccgaaccataccatcagccgaccagcacgagctccgattccggttccgatttagtggtccttgcttttatggcttctatttgtgagatttaagtacttagtaaaactttatatctaatttcttcaagaccttatcttatttcatgatgcaattcttctagcttgttaatgactcattaagaatatttgtctttcaaccttgttagagtcaagactccacatctttgtccggttatctgaatgaagtaattgctctttatgcatggagtagtgtttatttatttatttttttccctgggaagtgcatggagttgtctaatagtacgtcttatcagcagaactgtgatatataattaaaatattaaggatacagagtaaccgaactggctctaaatctaacatagtacttaccaacaatagtgctccttttgactaattaattctcactattcagaactttcttttgatacttctgcctattttcggttttcagtttacctaactttatggatctgcatacactaaaattatggcacaacatggttacttgcacagaagtcagccattttacagccattgagagtgattgtcctagaagatatggcttatatagttcatgtcaaagaatttgctgagcatatatcgtcaagccttgcctcacagcagcagctagttcttctagaccttgaacgaagccctccagaggtgtttcttactttcctgttgctttcctttcgtcttatttcctttttgcttactcttatcatttgctacagttactgttgcatgcagtggagaacgaaaatgcatcagaacttcgtcaagtccaaaaatcattttcatcagtgtttcctgttgaagttgacgcaggtgttctacctattgtacctggtcccatggtaaagccagtgattggatcatcaaaacgtgaggctgctgatctggcttgtagtagcaagcatactgcttttcaaacatctttggcactggatctgagttatattacagaagatgccaagatcactctatcatctgtgaatgggtaatctcccctcccaatgaggcgcctttactagtttttttatgtatgtcagtgcagaaagacatgcagttgtgcgttttcacgtacagattcttttcaacaaattaaagtttgcttaatgcataatggacattggataataatatttttgccactatatgtttccattctattaacttgatctgacaggtaatttgtcttttcctctcagaggaggaattgtgtcatcaacacataacaaaaataaaatctttataccatgcagttattaatatgatgaatgattttgcgttctgagatacatcgattagtggattttgaggaccatattttgttgcttttctttgtaaacatggtgacatgcattattttatataaaagaacaatgagaaaggagattttatgattctatgtaattacttttaagtttttgcaagacattattcggaagatcaatatattacagtaggtgatttttaactctttcctgtggcggcttagaagaaacaagttccagaaacccgtcatactcttaaataggccgccttctcaggagtctaaattgaagcctcttaaacaaacacatttccatgcgtgcgaaaaagatagaccaccataccttgatattaacagttaaatatccctgttgaatatgtgttgcatttataataccaattccttgggagctgttgttgtcaagtaaaactggcatctacttgaagcttagttacctttgaaaaaggtaccacttaagtaggtttctgcacctctctctctctctctctctcgtctcacattactcccggacatattgatttgtctcacctcatgtatgacaacatctttcttgagtctttcaggtgcctttgtgcctcttttgtctgtagtacttattttcatcttgtgctaaatcactgaatcttacatggctcatgtaataatgcagacattctgaaacttcagcatctcttcctaatctgttcttacatagatgtgcttaatactgaataacatatttgttattgcaggtggcttcttggttatccaataacatatttgttcagcaaagagcatggcgaaaaagctatgcgtaatctctctttcaagtctatttatcactacaagctttttgccagcaggttttgacacttcctcctgttgttaagatcacttgtttcttttctcacacagactagtgatgaaagcattctattaatgtacatacagaaagggaacacttagcccaaagctccaggaggatgaagtactaaggttcgttgtcttgtttatattgcgtaagatttgcatacatatatgttccttgttttcactgttcaacttttcgtgcattgcttgaacaagcatgcaccaaagcccaaaacagtgccatcattacctacattaacatgatgtgaggcttctttctattatgaccgaaagtggaggagcagctttaggaatgcatgcccaacagggcatgatgtcaaaaatatattggttatgatggattcacaacctatgttcatgacatcggagtaggggattgaacgtatggtacccacgaacatgctcatatgaaagccatttcacaagtaatggggataaatataacaatatttatgcctgccgcacaatagacatctatatgttaaacctaatcgatgaagtattgtctgcttcatagcttaaatgaatctaaaaagtgattcatttgcttagtatgcaaaatggcatatatatatatatagctttcatctaacgagtatttttatgcttgcggcaaaatggttgaacctagttttacagtgccttgtgatgtggctaagagaagggaggaggagccgtggattgaggcatttcttgctcgcatggagggaaagctaaaaaggtgcaaccaggtgtggatatcgatgcggttggaggtcaaatttttggaaagcaattcacaggtcatcgtcgtgtagccacaaatcacatgacatcttggagcgccaaaagaacaaaataagcttccaatagaaaaatcagagccaacagaaaaaatgaagaaaaaaaaccttcttaatgctcttaaattcaaatcaaattacagcatggttgtaaaaaaagggaacatatggaaccagcaataatcttatgatgctttatgctctttccagcagctgcacgacttctgattcatttggcaaagaagggattgctcctttcttggtagtggtgattgctccacacgcattggcaaatctcagtacttccctcaatttcttctcatcctgcaattcatcacatatgattctatgagaaacatgtagtagttggtagattaagataataagtctcgcagctcgaaatcttttctaagtttagttgatacaaaatcataatgctggtcatttaactcacctgcaaagctgattggtcttccacgatctttcggagcaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcggtgtcgggcaattgagacccgatccaaacttttctgtcgggattttctcctatcgggatcgcctcgagctgctcggccggcgaaccccgctcttcctcctcccgttgatccagtttgtcgattgtcaggggatcctttgtctcgtcgctttggacggagatttggaagcatcgtcggacgagctgttgatctccgcgcatctccccgactccgtttttggtcgggaatcgaacaaggagatggtacgtcgagacgatcgccctgagggcgttcaatccgggtcgcccgagtatggcgttgtaggccgaaggaacttggacgaccgcgaaaatgagggagactgtgctttgtcgtggttcggtaccgaccgtcacgggcagggtgatttctccttctgtcgtgacggtgtctccggcaaagccgatcaagggcgtggagaccctactaagtcgatcagtcggtagccgcattcgggagaagatcgagtaaaacaaaatatttgtcgaacttccgttatcaacaaaaattcgttttacatcataattggctattgtcgccgacacaacaacagcgtcgtcgtggggagtctggatgccccgaatgtcgtcttctgagaaggtaatcacgtcgtccgggcgcggctttttcgtcggctccccccctgtagacgtccccgatcccagtcgcttggagatcatgttgatgactcccgccgtcggctggttagtcggcgcctcttcagtcggctgggggcatcgatcggcagccgatcgggtcggcggaccttttcgaaatttgccgagatacccccggcggatgagattttcgatctcgtccttcaactggatgcatcgctcggtgtcgtggccgtggctccgatggaaccggcagtacttccgatggtcgaggccctttgccttcagagacggaggccgtcgcaggtattcttccccttcgatctccatcaagatctgcgcacggggagcggagagaggagtgtaggagtcatacctgggacgcaccggcctcggagtttgtcggcggggtgatttttggatctgtcggggtggagaaagccgactattggccggaggcctgcttggttcggcgggctcccgaccttttcttcgcttctccttcagacccctgggctcgaccaagcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcttttttcaaataaatctgggtttgaagcatccagagctggtcttcgtcctaccaaacttggatcgtggtcaggctaattgattcgcatcaatgcttgcttttagcaaagttgtagctgagtttctaccaaggcaagcaaaaagctccgggctggcacaattctattaaaaataggtaggccaaaatatttgttgctgcggtatgttaggtgggaacactgcctcccacaaaccccatttcaattaatatttctaatagctatttatttttctagcataacttgtctagcgacttttccttttaagagatcactgcagacagcctttgacgatagtcccatactcattccacagacaaatgaaccgagaatgtacctttccattttccaatacactcttttcctcatcaatctctctatttattgtatgtcatacctacaaatttgtgtgccactgttatcattttaaatgtatactatcttactacgtccattttcaatctgttaagagtccgctgtcaccatggttaatagctctctctaaagctcagacaaataatttgaaaatatttgttccaaggttactcctacggatgatagcattggtctaaaaggttccaaattgttgttataattctttccgttttttgacttggcaagttgtgtacatgataagataagtatccatccagaaatgaaagtttatattagatatatgttatcgttcttatccaatatgacagtagtcaaggctatcaagccatgtcataagtccatagaattacaatcatttatccagtgttcacgttaattagtttagttatttacatcttgcatgtcggatactattattgtcatgcatagagagatcactgatcccagaaagggttggatacttggattcttcttttattaagggacatgtccggatccatgcccctgctgccatcgaggagataatatagaaggtcggcgtcatcaagtcgtattcgggaaccgcgatcctttggaaacttggggaaactctccacgaacgcacgcgtgacaaaggatgagggccagggcttgcggtgataattatattggatgccataagaagacgagccatgtcacgtgctgagagggttctgcacgtgagtacacccggatctccggatagatttcccgattcctccctggcaatcggccacgtgggaaaagacaagtgggtgcgaagagtccgtccaatccaaatggctgagctgtctttgaccgtcaccacgcctgtcacacccgcagaattggaccaaagggagggagaaatgctttggaataattggaagcatgagtttgagacggaaaagagagagcttgatgggccattaacccggaagaaaaagacctacccatgatggaaaagagttgatatggttttgttacagcagatactcggtttggatggaaattgctggagtgaggcgatgtatgatagaggtaatggcaaccgaacttactacataagtcgtcgataaaaaatagttttgatggagacctttcagtattcaaatcaaaaatctgaaacaggtgaaaaaggatgtacgaaaaaattatatatcttgggaggtcatttgttatctctatttacagaggcaagagcaatggaagaggagaattagagactactccgatttttttgaaagtactatcccaagatcttcaatctgatttcttgatattgagtgatagtagctattttatctgatttaatgaccagttcttagtaatggcatgatttgatggaattgtattagaatttttcgtcaatatttttgaaaacaacaattaaagtggaggttggaagggagaggtcgaaaaaatatggcccaatgacttaccacgtatattgttggagatagggattggtgtggatatacagatcggagccgacatggggtcagagcctgaaacttggattgggtccgatgcccagagaacgttctgatatcgagagcaacgatcaacgtatagatcagtggtctgaaatgcatggagattgggatcggcagtaaatgagagggttgaaactcgaagttcgatcgcaggtcattttgtcgataagagagatggttgatgtgaaggttagcaaattgatgcgtgcagagatgagagtcggccattgatagagaagtcagcagccaaaatatggattgttggatcatgcatgggcatggtgataatgaagtcaaaaaattatgtttaggtcggcggctgatacgaggattaatgatcgatgtatggatcgattatgactggagttcagagttccatccttaacaagctccatataagcttatgatattgttcgtatgcattcccaagaggaggcatatggcccaatgcaaagagagatcgaattccatgactgatatgtatgggagaaagggtccaggcaacatggaaaagttctggctggtgtaacaggcacaaccctggccaactcattaacattttatatcatgaaactactgtggtacttgaaaacagagcttgacagtgttgggttgatggttgaagcggcttgatcgttggttactgtaccagaaggagagcctttgtgacaaatgaggccaatgagcttgagaacttcaactcaactatataataatacccttttgatagtgaatagtggatgttagttccatccaaatccttctattttttttttttggttggttgctgtgatggcatgtctattgaatagtattgccaaaattaatatactttttgattttgttacgaaatgtgttggctgatttgaacaaataaattagaccttcgtctatcatgtgatagacggccgcgcacggtcatactcagcgaacatgtatctatgcacaactattcatcacacaatgaatgatgcactgtatatcatattttacggtgcacagtagagaactcaagctcaaataaaaaaatttaaattttttcttccgtaggctggttgctgtttgacatatcaacatgagtaatgctacgataccataaaaataccggataaaaaattacatagctgtcatttaactctttcaatggagctaaagagggattttttttggtaaccagctaaaaagggatttttgtgttacacaaaaatgtcggaaaaggtattgctctattaacatagaggataaacctttcattgagataagtcaatgagctggcattatatagtgacatgtaaaggaggttttcaatataagcctatatcaaatcttgtctaatttaagacataagtaattgatttagattttatatttaaatttccacaaaatttcaataattacaaatattattttgttagagtaccaaataatgtaaaagaacagtctttagataagtattagcaaaagagagagaggaaaagaaaagaaatttgtagaaaagatcctcttttatcgaacctaattatatactactctagtctctcatgtatgctttgacattccaagttttcgaccgttgatagctatcatccttcttgttaagatttgacgtctcgagattcagtctacattgagcccatagtaaggtccgcggtgaaaaacgaagtccaacgagatcaagatcatctcaaacagagttcgaatagaggagatacgagcttttgaagtcggcatgagatccgaggtggcggaggaccgccgacggacgacggtgggcggcggcatggctgcaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggcacgacccgagcccaagcccaggcgctcggtgcgggcgcggcccaggcccgcgcgcgtgggccggcccaggcccaggcatgcgtctagtcttgtactcaggtccacgatggatcgggcggtccatggcggaccacgtggaccgtctgggcgtttcccaagtatttctcgcggtccatggtactattccatggaccgatcataatcggatggcccagggacgtcccgatcttgatccaatagcttggggcttgatttggggtttgtttgggcttgattaggattcctaatcctaatctaacccttgtttaaggcctataaaggtctgggaacagtgaattgtgagggtatggcttcttggatcgtgaacaggcccacggaggcctgttttggatgcgggcgtggaatttcgcatggataccaaagaactcgagaagagagagagactactcgctgagagagaaggagcaggaggctcctaaacagcggataccggtcactttaggggttcaggagatttttcaagagagagagtttttgtgagggagaacttcaggagagaaaaattggatgtataagagttgagggagagatctcctcttgtaatttttttttcatagtgaagtttgcatgcctcgtggagacgaatccttttgtggctgatgcacgtattttgattatttttattttatttattttttttcctgctgcatcgcgtggtactgaaaaggttctaagaggtagtgtcctggtcagacatccatctaacacttctgtccatgtcataatttgttataatataaaatattcattatatctgtatgcatgcgacacaaggaattaagaaaagctcaaattttcaccctgggcttgcaaaatggtctaggtgatgtatgatccctttttgtgctgatctggagctgcgtattgaagtccttacatggagccaccaactagttccatgacatgatttgagagaacacttgctgcttaaacaccaactttttttttttggttaagaaataccaactcctttagccacatgaagcgcggataacaaaccaaaatgagcagctccagggatatgaaaaactaaatattaaaataaaatattataaatatattattgacataatattgtcaactttgatactaaaatagaaagatgtaatctaaaattgaatctgttatggaactcgttttcttgatcaagtagactgcaaggcaaaaattcaccaaccactgcacttatgatgcaatgactccaataatctagattcatcaaacataatatttcttcggtgcaaaaataaaaagatttattacagtttatagcaataaatattagtttatttctactcgcatctgaaagtgcagtaagacctaaagtataccacaaaccgacgcgcacctacttcaaaattgcatacaagttcgatcaattcctttgtttttaggttgactagataaagaattacagtaatatcgagctagcaactgatagaacccagtcgcaaaggactcgtgtttagctcgagccaagccaggtcaacattcgatcaagcgcaggtcaacaagcctcggcctgtttttgtaacgggtcggtttgtacccgaaagttccgatttcatgccgtctttcttaacggatcggatcacgcaaatccccaaattcaacctgatccgttttgagacctcctaggtctccttctcgccagatccgtcaaaaccaaacccccccacaacggcagccgagatttcgttctgccgatcggaacccaagtctcaacttttccaatcctcctaactctctgaaaaaaaaaaaaacatggaggtcagtgtttttctccctctttctctaatttcttggtctataaattcccgcaatttattcatcttcccttttttgggagagcagccggtaggtctttcttctgcgagcagtaaagattcgacaagcttggatgttggctctgaaaggaccctgtaagaaattttttcacccaagcatgatctattttcttggaatgaatcattgaatattttttttgtttgtctccctctctcgccctttttcttttttttttggggtaagaatcaccaggtaatttctaactcaggatttccttcgttagttgatccagaaaataatgatggaatcaaatgttgacacatttctatctgttatatttatgggagattttccccaagaaatttgaagcatctgtcacatattctgcaatggccattatagttaggtgcatttgttttcatgtgaaggggaatctaaatgcctgattggtccgaatctggatcgtgacatgtgataaatttcatcgcacataaacctcaaggagtgccatccagattgtgcagtgaattttccttaaaactactgcttatatccatctctgtcaatatagagcacttcttactagaaagttgatctcgagacaccaaacatatgcaagcatgagaagcaccagcttgttgatcataatcttctctgttattttgaatctacaattctatttgtggccaagcgcaatatttttggatctacaaatgtctaattttccaggcagaaatgcatagcggactgtaatttgttggaaaaactagtgggcgtaatagttacaaaaattctcaagagtcgtacttcctccacatttgtggtagttaaggaaaacaacataaatcagttgtatttagcataggtgatactgcacgcttggtgtttgggcacttttaactgatatttacatgtagatatgtgtgtttgcattctcactgtttggcattgttttcatttccattttctgaaatcatcacagccttaagcatctatatcatgtgaacaggtacccatatgtgactggtacttcagtattaggtgtgaaatataaagatggagttgccttggctgctgatttgggaggtcagtctatctgatatttaactgcataggaactttgccaagcataagatctgatactatacaagttgatttccttggatttatatatttgaatttgaccgtcatatcccacaaactcctctaagtcttccatgatatgtttatgcctttgttagcatagttcaagaacctgaatttcatgggaagtgaataatcctttttatactacgagtttctgacaaataagctccatatatgattcatattttcaaaaaaggagtgttcaccagtatacactattggattgatttttgctgatgcattatgaagcatggactggaaggtgagatatagatgacattaacatggcaaattttggaaaataaaaaaagttacgaaattgctgggatattgtatgtgtatgcataagatgtattcacatccatatccatgaactctatcacttagttatcattcaaatgcatagactacattccatacttcataaagtaactcaacattatgaactccagaaggaaccatttaccatgtccatcattaaagtgtcagcatctatacttgtattcaaactcctaagacccatatgccgcctgtcagatgttcatttggccactcacgtggtcaagcatgaggtgaaaaagatgaatgagtgctggtgagatagggaaaaatggatgaagtagatggcaaggaaaagaaaaggttccagaaaacaagagttcctatgaagaactagcatgctgatattattggaagtggtagagtcctgacaagagaatcagtggactttaagctgcagtcacctactgttatctatatttcactccaactagaaagatcactactatactgacttccatctatatctttacccgtaaaaaaatcatagcacatgcattgcacttgcaaggcaccagttccttcaaaaaagaaagcccttcaactcaccctctgagataactagcatcttgagcatattggggaggtatgcagtaccttttttggttttaaagagtaggatacttaaaattaagtcggtggcacatattctggctatgtctatcgcgagcattcgcatcctatatgttttggtacaaggtatacaaatcttacacattgtctgaaagttagcatattgtgtgcgtactgcagagcttggaccagctcaaatatgatgcaaaggctctgcttggtcatattgtctgaaagttagctatgctcgataatatgagggtttcctgtatttggagcagaaaaagtgggctatgacttgctttcaatttcactggaccctcttttagggcctaatgtcctaattatagctataagacctttttggtcctacattttaatgtagctaatgacattgtatggattatgtgcactcgaagtcttctaactgtgaaatctcattgactaataatgtttgattttcaacatatctgccaaaatgagacctactaaaagtaaattaaaatgtgaaacacctcaaattagttatgccagagaaaagttacataattactcagaagcaatcacgccttatatttgcaattcttccaacaaaacataattcccacgtatatgttattgatactatctacatctccaaactagagtcttaggggctttttacctttttttgttacagttatcatagtctatacaaagcagttaggagaagaaaaattggaaaagacgcaggacaatgtttgagttgttatagcttctaggacaaaaatcaaaacaaaattaagggcctgaagaatgactaaagagctataggagagagcacttgaaagcaaatgcccagaactagagaacttcttaagccgattccaagcagaagaggagcagtaacggagaagaaagagaaggcaatttttttctttaaaagtgatactgcattaggtaatgaggaaaattaaaatagaagatcagacatagaatatgctctttaaatttaattggttgcacaaatcaagtgtcttctttataatcaagtgtcttattctgaactgtcattaattgcctgtcatgtatatgatttttcatggtatgtcttgcaggatcttatggatctactttaaggtacaagagcgtagagcgtataaaagctattggtaaacatactcttcttggagcaagtggagaaattagtgattttcaagagattttgcgttatcttgatgagcttatgtaagacttctttaagagcaagctctcaaaataaacaaaatatatgattaagtgtaaactggttctgcatccttctgttttcctgaccatcaagttctttttgtagtttctggatgttctctatattttttttgtcttactcttttaacagcatttaagttgcatctctttttttactaattacttcattcccctctttcctcagcctgtatgataacatgtgggatgatgggaactcactgggtcctaaggagattcacaactatctgaatcgagtgatgtataatagacgcaacaaatttaatcctctgtggaactcacttgttatcggtggagtgaaaaatgggcaaaaatatcttggaatggtatttttatatcttttttagtgtacatctgtatgtttcttctcagtttccttccggttaatttagaaatgttgctattactgtatttactatggtggaaactgcccaggttggcatgattggtacacattttgaggacaaccatgttgctactggatttggaaatcatcttgcaaggccaatatttcgtgatgaatggcgcgaggacatgacatttgaagaagctgttaggctgctggaaaagtgcttgcgtgtacttttatatcgtgacagatcagctatcaacaagttccaggtatgattgtttcttgtgagcatcttacttgatcgtcttaatatcatgctgtatccttgaagagtagatggattgttcttgccattttaaccaaactatactggcttggaaattgttttattcagtcagaaagttgtttgctctagctttatgtttatcatttctaatgtaatggttgtttttttgttcgtttattttatgtgttgtaatctttgtgattggatacattcacagatgtggcccctctttcttatacaatgacctcaatttcacatttatatattaccatggtccattgttagattctgttagattacattattgtacttgcaatttgtttattaccatcactataaaaatttctttcacagcacataacattgtaattaacaggttcctgtctaaccttgaggaaaccaaacattatgaatgactgacgcactgttgtctgggaatatttctatccaggttaagtggaataagacatatgacctggggcttaaaaaaaggaataaaccagaatgaatctattcaatggtcttgtcagtttacttttatccatgtcaagagtatgaaacaagtaaaatgtttttttttgaaaactcccttctgcccttggcgggataatttgaaataaaatgggcaaagggtgtttatactggtttacgctacattatcccccaaaaacatatagggtctgaaaatttgatgtatcttgtgataattttcctaggacaaatcatttttttaggagtctgtttatcatttttaatattttaaactttggcacagtttaggcctagcgaatttatgaatctaccatcgatggatatccacatagcagcttttttcaaaaaaatcatctttagtgtgttgtaaaagagaaactagagggtcctatggaggctctagatcttcaggcggactcttttgaagctatcggtaccttgatgtgtactgcgttaccatttagggataacaaaatgcacctaaaaggtgttattggctatccctaaaaatttcagcatggaggtggaccatcaagctcttgcttctcacattccagctcaagtttaaccttactgggagttatccactgcatctggggttcagtcatccaaataaggcctaagttcattgcttatactaaccacattctcttggacatgatatgtccctctcaataggatgttcaatcttatctcgtacataggatgtgatgcatgtggaaaaatatggatggctgcagtcggggtaaaggagaagtataatagaaaataaataagccactataactaaatgctccatctctatctgaattgattgaccaatcatcataaccactaataatttatgagaggaggataatttagatggactaaacaaagagtcctccatgaacaactgaacattttctccatgtgcatatcacatgctcattgttagttgattaaaatgcaaggtgggaaatgacataagttgaaggacttcatatttaaactattaagcttttgtgtgatgtgatgtgcatgtgattagcagaataggggtttgtgttatagggtttggacatataataaaggcatattttagctagagttgttcaatggatgcacactacttctccataatcttgttgtgcttagagcttggcagaatctttcatctgtaccattttcggtctctcctttaccttgaggaagaatagggtgaatatttacttggactttcttttatttccatccataaataaaatgaatcagcctagatctggtacacttaaacttctttgctcaggcaagagttccaactgatgatctgctaagatgtcttttaatccactaagggggtaacaaacctcgcaagcttcttcttcttcttgatttaccagtggccataaccattaatactttatgagatttaatgaggataatttagatggactaaacaaagagtcctccatgaacgactagacattttctccatgtgcataatatgtgcccactgctaggtggttaaaatgcaaattagggaatgatataagttgaaaaacttcatattttaactaccaagcttttgtgtgacgggcatatggtcagcagaatagggattgtggtataaggtttggacatattagtataggcatgttttaactaaagttgtgcaatggatgcacaccatttcttcatgggctcatcatataagcctctccaaagcagttgactgcattaaaatatattagaagataattaaaatttataagaataaactgtgtttctaaaggatggctgtcttggttgcccagacacccatcttagtgctttgtatcatgtttgagtaatgttgccaagttgctgcttctcactcacttcatctaattggatatgtcatgggtcattttggaactttgatttctgtttgtgtttcttatattttgaatttattatttttgggctaccttgactttaagcacgagcctagcacctagagcacaaggcgactccttatgtgcccatctactgcccagtcttttaaaattttgaatataaaagaatggtacaatgctttgaattaaattagaagttaattaagatcaagtaaataaagtaaatacttgcatacttatttgagaatctattgtcatgtaacatggaaagtaaaccagtaaattacaattttttgccacaatttatgcatcaatattagtttatcatcctaaagtacatgctcaataatatattgtaatgcaaccggcaactgcaataaatgatgataattgatataagtcgtcaatgaacaactaatcaaagacaatgaaagtattaaaacatcaattagaaaactaggctgagtcctccccctggacaagcctaacactcaagaacaccattcctaatacttgatctgcttgaaaagatagtcaccaaggtttggcatactggtcgatatcggtgcatactgaccagaccatactgtgccagtactgaaccggtacatggtgtagagggtgtattgacatttgatatgccgaaccagcccctgtacctatctttctgatgctataataagatgctatcgatatggggtccagtattgagaaggtggatcttgatagtcacaaatcaacaaccatgtcttgggtacctaagcccaattgggccacttgggagctggccaggtggctatcaatgtaatatgggccacctaggctattaaacctttagtaggcagcttggtaaaaaggaattattctaatgttgcttcaggatctgtccgtaatgcatgcttgtttgacttcccaaatttacaatacttaaggttgttctcaccttgcagaaatataagtctttagcatggtggtctccaatttgacgtctcttctggaaacactacgtgcttaaagaacacctccacaaatcaaatcaatccgcatgacagagacaacctgttgtcctcagacatgagtttaccttcaatttacttgacatgcatctaagtacaagacatttttgttgtgcttttccacttaagccaatgtgctctggtctgatgaaagattttttcttttgccatctatatccttattatttttagggtgaaatagatcaatggcaacaaaatggctgccagaggggaacctggtttatattatattgtgaattatttttatagcttattctcggttaaccttatcaaagttgtatttcatagtgccagtttgattatcttgagccttttctctggtgctatccacaaaaaagcatatacgaggatatttcctcttgtgatttcttctattggcatgtccgatattactcaattgtatttggaaaattcaagagttgtttttgcactaatgaccttgatgtacaaggaaataccattcttctaaagcccaccatataattttcttcaggccaatgaaaatcatatgccgataactctttaaatccttctaccaatttcataaccaagggaacctttgtggtaatcatactccctctgataccaaatagattcatggatatgcttgtcatctgtcttaagctgtaccatcctctcttatggtttcatggtgtggctttgcagtttcgcgcaatgcctttgatctcagataacagaggccactagtgcaatcctgggttgtcaagcatcttcttgtcttcagagtctcattgtcatataataatttactggacctgtttccccccatgattttccatagccatatgaatagcattaaagtagacttatttctgagtgggaagttttcattgatggaactgtaatgatttcattcaatgcggctaaatgaacaggttgtcttatacatggctgtagtcctcaagattttctcaaaacactccatatattcggatgctttttcattgttaatatactaatataatttattctaaatgcagattgcaaagatcacagatgaaggggtgactatatctcaaccctactctttgaagaccttttgggggttctctgccttcaaagatccaaccaagggtgctgagggatcatggtagacgctttatatcatgcgtttcagctaaacttgaacgtcacataaaactgaaggtgttgaaaaagtactgtacttcttaaagttgtgctccaactgttttctttgtgatggtgaggggatattgaagatgatgctggatatttacgttaagatggtatgcccaaaatcatgtcgttgtgcttgatcaattccaagcttatgagaggtcagcagtgttgtgatgcttgaaatgattttcagactggtagtttgtccagaaagaaccattttatttgccagcgaagggcggtaatttcttcatacgttggcttacaattcttgtgatcattttgcattaagaacgtcttccttcaatataatgctccactggtatgcatggcgagcatacctagatttcagagactgcaaaggggaaagcatctgcacaagatattttgagaagagtggttgcggaaaattgcagctgaagacttacatggtagctttactctgtctggttcaggaggtttaatatttctttaagaatgcattctcgatcaggccaagatacttcttgaatgcatgtccctaccatgaggcctccaatctgtctgtctatagttttgcttcgtagcaccctttggaacccctcatttgtcgaacagccatcgtccttgcggtttaccctccaccctattctgccaaccaacttgatgagatcactgatgcaaataattccaatataccaggatcgcctggtatcatttttctcttgtatcgaatttagaatcgtggcaagaagagagcgcagttaatgttaggttggtatcatcaatgttccgtattttccatgaaaagatgtgttggagnnnnnnnnnnnnnnnnnnnnctcatctcatgcagaccctcatcaccctacaggggcacggcacttccaataacatgattgtgtttgcacacggaaagcaattgttagaatatttatagatatattttgttagcacgtttggaccggtggctgctctaaaacattagcacatgtacatcaaatggcttgcatgagccacaaccctcccatataatctatatattgcaaggaacatgcaactcaaactccagagaaccctgaccatgaagctggtccgatatccataccagttgtttctttttcccgaaaaatcctcgttgttttcggttatttctgtccgtctgtatttcctttatgattccccattcattgcccacgtaacagcagtaaacacagaagcaagatcaaaccccccatgacccaggatagtggcatctctcatcatatttattcttctgatgatggtagtgatggcggcggtggtagttgttgtcacgatgatgccgttgttgacgggttttattttggattgcacgtttgattcgtgcggcaaatgagcataccaaccttggggaactaagcggtcagacggaccggcacaacattctttaataatcatcaacgactaaaagacacaatagtccttaaaaacagcagttcacataattaatctttttagatgcgacaattatttgagagaaacttaagtcatgcattatgtggatgaacctgaccttgcaacaccaccgattcaaacattggtgagatgctgaacttttagggagcataatagcacaaatatcagagccacgttgcctaaccaaaggcccttgatctgaagattagaaatgaccacctgatcaacatcagatggctattatgtgaggacacagaagagtacagctgctcaactacatgttatcatgagatcgagcgccggacgtacatgatacaatccattcggaaacccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagggttccaatgcttccctccacgctaagtgtggccacctccttccctccaaatttaaattcgaacatctacccaagccccgatccaaactcctatgagtcgagaagaaggaccgctacctttcactcgccaaaacaagtcatccctctattgcagagatgcaaaactatcgatcaattcctcccaatccatgccgcaatcctcaaaactggcctggaccaagacccccttctgctcttcaagatccttcggctttgctccgccttcaagtccatggactacgccacccaaattttccacagaatcgaaatccctgatgtctatcactacactgccctcattggtggaaagattgctgccgcctcttatctcgatgccatccggctttacgctcgaatgattggcaagcccattgaacctgacctaattgtgatcacttatattctgaaagcctgtgggttgcagctggcattggaagaaggaagacaggtccatggtcaggttttcaaactgaagcttggttctgagaggcctattcgcatgaaattaatggagttttatgggaaatgtgggaagtttgatgatgccggatgggtttttggtgaaacgcctgagagagatgcggtcgctgcgaccattttaatttcgtgttactccgatcatggtttgatcgaagaagctgaagccgtatttggcggagtgcaagataaggatgccgtgtgttggactgcaatgattgatgggtgtgttaggaatgggagggcgaatagggcactggaattgttcagagagatgcagagggagaatgtccaacccaatgaatttactgtcgtttgtgttctatcggcttgctctcagttgggtgcattggagcttggaagatgggtccattcttatgtgggcaggtacaacatcagactgaatacttttgtaggctccacgctcattgatatgtacacaaagtgtggaagtattgaagaagctcaagaagtattcggcaagttggctgagaaggatgtggtctcttataactcgatgatagttgggcttgccatgcatgggaggagctatgaggccgtggaactatatcggctgatgattacaagaggtctaagaccgactcacatcacctttgttggtgttttaaatgcttgtagccacagtggacttgtggatatgggatttgagatacttgagtccatggtaaaggattatggcttagagccacgaatagagcactatggttgtatggtcgaccttcttggtcgtgtagggcgtttggaggaagcatatgagttcatccaaagaatgagcattgaaccagatcatgttatatggggggctttgcttggtgcatgtaagatccatggaaacttgaccctaggagagaaggtggctggaattttgatagagagtgaagctgccgactctggaacttatgttcttctctccaatgtttatgcctcattcgggaaatgggaaaaggcagtgagtgctaggggaaaaatgaaggagaggggtattcagaaagaacctggttgcagttccattgaagtggacaatgagatccacgagttcctattgggggatattaggcatccccagagagaggaaatttatcgaaagctagaagaattgaatgatgttctaaaattagaagggtattctcctgctagagatgtggtgttgcaggacattgaggaagaggagaaggaatgggctttggccatccatagtgagaggttggctatatgttatggccttatctcaactaaaccaggaacgacaatacgagttgtgaagaacctcagagtgtgcagtgattgccattcaattatcaagctcatttcaaaggtcagtagaagaaagattgtggtgagggatagaaatcgctttcaccattttgaagatgggtcctgttcttgcagagattattggtgaactctgatggaattcatccttgaatgcaagtccaggagaaaattctactctggagaagggagaaatttgattttcagtctaggcctcatgcttttcggctgtagagtaggcattgtgaaactctttgatataggctgcgaaagattgagtggattgatcagatatgcaaaacctgtggaactgtaattgaatttcattcaagaaccttactgtatgtgataacaatgttgttcatatttccacaaatccgaagttgttccatttgctgttatatgggtcatgaaatacttttctcatcaattgcttgcaccacgcatgcatatgaagtatgagttaccgtttcaaacatccaacttaactgatatgctagcctcttgacagcatctgcttcgctatggaaaatttagtcaacagttaccaggacatgagcttggtaaattattgactgaatttcatggttgattattcaacattttagccattccatctgattcagacataatctaacgcaacttcattagcatccagatatcctggtcgtgcacctattggatgcctaggatcttataggtgttaggaatacagtgaacgtgtggttgggaagtatgacaatttggtagcatgttccagagctgtcacttctaacttatattgatcgcagaaagtattggaaatacgatttgagttgcatgcaatgaagaatgaacgaagtctgttaaacttggatttctagttctgtttagcaaatattattggaaatagccaaagatggtcatcagggattgccatgatccttccaaggtttaatcacaggcctccccaaaatatcttgctatcttcactacacaagtgaagcaagttagatctgatgcctaaatgtgattctacagacagacaaaccttatacatatacctatatatgtatacatgcgtgtgcgtgcgcgcgtgggctgtgcgtgcatgatatgtgtgtgtgtgtgtgtgtatatagccaagatccttatactggaacaaacaggtacaaaatatacagatgggccatctttgtcccggcaatccactcacaacctcatttctgttatctgaataccgtcacccaagcacatcacattcactgatacaatgatcttggcattttactagtctatttttctttgttgattaatgaatttcacaagcacccataccaccattcagcaaaaatccactaaacaattgcaacctctgccatgtctatgaaaaggctcagaaatatgaaagatatttcactagtaaccattaaatattgattcacctccttccattagagtgatccaacacgccccacccccaccccctgaccaccccagccacacccaggcgggtgcaggagcacaaaggcgcatatacaatgcatgcacccatacccaccttgtctgcatgaatgcaagcacatagggaaaataaaacaagaaaaggagaaaaagaagaggtttacttctaactcaggaaatttctgttacctttccagctggattataatacttcatcttatcaattatcagttcatcactataagacccaaatactaaataccagatgaccaatcttgtacctaaaaatattggtactgacaagaatataaccgaccatgtgatatttattgaagcactcaatcactcaaagcacctaaaaacgagcttaaagaggtttaaagccttaataagtagatgatgcaaatcaagttacagggttaatatcagaagaaagagtttcctgcatgccgtcgtgtatacgatgtacaaaattaaagtttatgaggtcacattaaatctcaagtttagtaacttgttactcactatatataatcctgatagctcactataaccaaaaaaaggttaatgaagacaaaatgagaatacaaggaaacaagcatatactttaactcaaacaatatacacacaaaagtcccatgtttactctaatccggatattttctcctgctctctcctatcttctctctttaatttcttttttttgctcatgataagacaagtaagggtgataatgatcatgccactgagggaatgccttgaggataggatgataaactattcacacacacaaaaagggacactgttgtaattcagttctccatctaaactgctgcagctgaaagcttatcctcccacaaataaaccaaaattaatccagaatcacattagcgggttcatcttgcaatctcaagatacctttaaaattcatccctagtatacttcagataacaaatcttgttacttctgaactcttttagtattcattattcagaagttaagacttttgcattctcatccatgaatctgccctttatattgcacggtacataaacttgcttccatccaggtttttatggtcctcttttccatcctttctacctaaagatgagatcacacagtcacctcagctttgctgatttctgtcacccctagtcaatccatcccaaataatcaattaattgttctgtcccaatgctaatcataggcttcatttagttcacttatatacaagatttttggaaaaagtacaatttgagataagctcaaaggttacaaaacagcgggctcagatatctacaattgacatcgatagtaaaatgaaagaaaaacaaaatgattcataaaattgatggtcttaaacataaataacataattaagctggtgataattactcaaagcttttccataagatcaattcaaaaataggccccactgcatattgatgaaaagcttataccaattcagaagacaggaaagaatttaagcaaaatggaccaacaggatattgatccaaagaacttgcaaggatatgcaacaaaattttaatgattcaaaacttttcatgaaagatttcaccgcataaatcttaatttatatttatcgaatccagcaacttcgctatggaccagaaatacagatttgaagctcttatgattcatccaaataatgactagataaaggcatacatgaaaggtcaagttgcctggatagcaaaaacgcaagaattatttttgcatatagcttaatttgcagcatgtaacatttgtcattctagagaacttccagattgcttaaactaaaaagatctgtcatgtaagatgtcctaaatcctaacccacctttaaccttggaggattctttttctccccttacataacaacctgaatgcttcatctaagaactgaattgattagtcatagacctaatgatagttcatatcaagtaatcaaggtaacctacagcctgaaagttcagttgaaaactgacaaaaagtcattgcaggcagagtactggacattcctccccagctcagacctcaaaggaccaaataaagtgcagaaagctggatgaaggatgaagcagcatcccgttttattttcttttcaaacacctgttaaatcaatcttctgctaatgcaacgcaatggacaacaagaaactaaacatccaatacaattcttcccagattccagttaactgtccaactgatattagatgctggtacaccatcaaaatagtatcaaatttctgaagtcagagtcccaaaaaaacttgctcatggattgcaactaaaaaggaaaaaaatgcatcgcagattgaaccacaggcaaaatcaaaatcagttaattagaacaggatacaataacctgagattccagaattagtcgaaccacacatccaacagaagctatagactttcacgaatttcatcaacatcttattaacaagcaaaaactgaatattgtgctcagaaaacccactaatacttgtcgacaaagatgcaacatgatgtaagcacaagaatcacaaaacttgtcactacaattgattcaagttcaattttatataaaaaacaattaaacaaaacttccttgtttcagcatttcccaactcccaccaagacaaatatcatagatctgttcggtaacatttaaacaccaaaattcatagaactcattaatccaaatgagcaactaaataatatttgtttcaaatatttccctttcatttcagcaatccctaccaaaataatcacggataggaaaaaaatatatacaagcagaataagggaggaaaaatccatatttccaaaaataccaaacgactgaaaggatcagtgcagttgttctcagataacaaaagcatataacaagatcaatgtttaacaaaggtagcagttatcattattctgaatccaacacaattaagtaaaaacccaactttccatcacaatggagccctagggatcaccaaaccctcttcccccattacggggtatcccaaggcttgggctcggggacggcgacaaccataccttggagctcaggcgcgagtacgacctggcacccaagccttgcgtgcttgttgaggatccggttcctggaagccctcgtgagcacgtacttctcgtcgtacgatggaggggggagcttttcgagccactcctgcgcgatgtggacctcgcactcggcggagcaggcgtcgatctcctccaaccggtgggaggccgggtcgatgaggccggcgttcatcagggcgcggacgagggtctggccggagagccccaccacctcgcgcttcttcccgtcgagatcgatggcgaagagcttgacgatccgatcggcgaccttggcggaggcggagggcgcggcggaggagcacggccgggcgacagatttggaaaggagggagaggtggagagggattcgacggagaacggcgatcgccatgggtaggattttggtttcggggccttcgagcaaggcgaaggacggctgaaaggggatcggttttctttggaagaacgctggtacccttgtaacaaaagagacatggcagggtaattgatcagagatgtgtttcctgactacgaaagcacgaaatttggattacgtattccaatacgttaatacgcgccaaccatgcccaatttgataattagtgctcgggttcaactttgttttgtgtgtgtgtgtgtgtgtttcctctctctcttattgttggtattgataaagaatttttttggagtattggcttcgaatgataattttagtccgtatatcaatccaactcgcctcgtatggtatgaattttatccaattcaattaaaatctgagatgaatataaattttaaaaaaaatatttgaagtaaattttgatcaaatattgataatagtatatcttattttatattcgatccgatataatattaatatatattttttaatattataaaaattttatattatttataactattcgatccgatccgatatgatgtgggtacagaatggatatgatatgtgatttttacttggagacaggatcgatatagatgtgacctgatcattgaccattgccatctctgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttccaagtaccctttcgatccaacgaagcttgctttggaatgctctacgaacccttccaaataaccttggaagcttggacaagcaagaagaataagagaactcatcaccattaaaaatctcttctcatctcttttctctatactaagaaaagagaacactcaagaaagaatacaagtaacctctcttactcaatacaatagaagttctcttttatcaatccaccttagccgaacaagctacagcaccacgtaagtccaaatccaactaacccattacatgagttttgaaccaaacccaaaataaacccaataagttaattggtgaatttgatatcaccaaacctaacatgtgggatagggttcaggtgacttggtcatgcaaggtgcagtttccagaagtttttgataattggtatgatggtgcttctttttctttctgttttctcaattacgggcagacttgcacttaaaaatgaggcagagatattctttatagtaaattggcacatgagacttttcctccatgttgcacaactgaaaatctatactttctgtctgtagggttgatggactctaatgaaggggaaaaatagctcagatcaagctttgtttggaataaagattaattactgtcctatgcttcacaaattctgtctaatataactcttggttacttggttatgcagacgttcacattttcagaacaccttagaaataaattctgaaaaaatgtcactacccagagtctgctgagaaattccagaataaaaggcagcatgtttgtggtgaaactagtgggatgatgagtttaagaagctctaggagtttggcaaaagaaactccatgtgatcctgtggtcattcccaggcgttccccgcggcgtgtttctaaggttcaatctactcttttatttagaattaagaaacagtggaaaaagtatagtatcagactatttattctgtgttcacattattgttgtggcactcatgttttacaaaatataaacataataaacaagctgcctttattaatttggagtcaaccaaatggtggttcccaccctaacctgagatttcctggatagcaaatttttatcatttttcactcccttcaagtcttcttttgtttcaccctatcttttaacccttccaagctttaacgtttatctagttccattagatccacataagatctaatttctaattcatcattggattgtgaatgagaaagctttgaacccaacagtaggcttgagactagagaattttcactaccagattgcttccaatttcatcttcatgtgcccaatcatgtgagaaatcattggacgtcctcagttgtggacaactgctaatcatggaattcagctttatataacagtacttctaagtgttttaattcattatttatggttttcaattttattttttatttcttagtgacttgtgtgtggtaaatcatatgatggaaggttgaagttgtagaagatgaactaatgtcctcgtgttggttaccctctttgtttttctcgtttgtttaggcattttatgtctaggagctttagtaggttgtagcattttgtttgataagctatataattttcttccagttgtgtaccttataacttattcatgatggttttcttttcattatttaccattttttctggagtgggagggggttggaaacttggtgcatatggatccattcgtttatgctagatatcagtatatatgctacagttttgtcttttctatctaaattatgtcctagagctgtaatatgattgcagtatctgattggcttgatgagctatgtaatgtttctttcctaatcatagtttatcatcgacttcggtcttgaagggctagattcagatcattcgtacccttttctgcttgattatatagtttcttgtttcagaaatgtgcataaaaatccaggacatagaaccatccccctctcttttctcaaaatcaagtggaaattattggctgcaacaacctcatcttggaattttgcagtaccacaattggcaacatattgcatcaaggattttgatcacactagaattatctggcattttgttagattgcttggactggctgattgtccataagtaatctctttcggtcattgctgattctgtatatgtgccctctttccaaacatttggtttgtgttggaagaaactcttgacaacatggtacaacttcaaactaatatgtccatcatgtgtaccagctttatcttaccttgagaaaagcttctgtatccatcagtacttgacctgattgctgatgtcaaacactatacatattccattacatggagttagctgaatttttataccattacatggatatactagtttattaagcagcttctgtatacttatcagtgaaattccagactggagagactgcagagaggaatgaaggtgggacattaagaaaaaataaaacagcagatctttgacacttttggctttcctgttttgttaattcaatggacatggtcctgcaactcttttggttctaatagaaacattgcatgatgggtccttcctcctggcaaatgtagttgagcctgattttggcatcctaatgtgaccaagggcgcccacatgattggctcaagatggttggaagtggatactattctgcttctttcatgctgaagcgtataggaggcctttccttgcttccataatgctgaatttcacagctcaaaaggtacatgatctatcatttcatgcctctgtaggtaatattagttttatttttaattccaaaatggttggactggaatgattaaattctatcttgattgcatacatgagctatcatttctcctttaattgttgaaagaaccagtggtgaagaattcatcctgtaatctggaatttaaatttcagattatgctctttgctttcttcctctctgtatccactctactagtttctgcaatcaatccccttctagcatacttggaagatccttacaaaataaaatagagagttgcttcttttgcagtttcttataatctgatgaaaatccttccaacttttcgagtaaatgggaacggtcgatctccatcctcatgagcataagtacctaaattcaccatatgattctcatgcctctttggggtatcttaaatgaaaaatctgcccaattaaaatgagaaaacaatataaaataatgacaaattaaatgcatctaatttaacttcattgtcaaataaaaaaatggatattcctctgttttttaaaatataaaaagttttaggtgaggcttccctccttttcatcaaaagaaaaatcaaagcccatctaaattgcattttcaattgaaattttaatttacaaatcataaaagatgaataaaaatatagaccaatgaattgcaaaaaggttcaaccggaaataaaaataaaagtatgaatgtaagaagtcattttaaattgcattttcaacttgagagttattgttttgaaaattaaaaaaaaaaattcctggcaaaagagaatataagttgaagcatatgtggggttttcccctccttttcatcagcagaaaattcaaacattatttagactgcattttcaactgaaaacatcaaaaagtaattaagttataaataaaagaaatattaaaaagcttgcttgaaagtaaaaataaaatataaatcaaagaaaccattttaagtagaaaatgcaattgggaaatttacagggcaaccgcattgagcttcagttaactctattctgtgatctacatttatattgagtggttgagctacgcagtttcagactatggatcataataacccaagtattaatttgtccatatatgtatcgaaaaataggtttcgcatctagactcgataatgatcctaaccaatcaagtgtgatttagatgctgatgcgggcagaactggataatcatgaaattctatgataatgaaaatcactaagttcgcttccattttatcattgcagatcatccattgcttcgctggaaatggactaatgatcattttaaaggaaaatttatttctgctaagcagtacagtgaatcataataggctgtgttgcaatgatttttttgaaaaacaattaactattggatcagccttaaaattaaacttgaataagtcgaactgtcaaaagtctctggtcgagatgaatcattattttgccagctcaaattagttttgaaactcatcaaatcaacacttggtcgcaggtttgtctgcccctcaaatctataggtcaggatgtcgtggtttagatcagcatgaaattaacttcagagaatttatctatcgagattttgacagagttcttccttagaatcaatagtaatcacatggattgtagtgaacggtacagagccaataaactggcacttagttatgagaaacaattacgtggattacaattcaatgggacgtagccatgagaaaaagtcacatggattacagcagaattctattctaaccatttaatgtgatcgagtatggcaatcattggcacccgcgaattccatgcaggagagttttgagtaaacctctgccgctttaggatcccatgcaacatcccatcataacaatatggaaccataatttaggaagatggcattgatggcaagagccatgaattcaaatgatggatgtgacttgctggttatgtggatcattggatgtgtgcaaaaaattcatttccatcactcttcttgattgaaactcctctccactcaaggaacaagttgggcagcctggttccacgttatcgatattgttgaacaaaaagaagcataggtggtcaaatctttatctatctgcatcccactgaacttaggatgggacctttgtattttgcaagcatgagtgaacctgacataaacgtcttggttgctaaattctttgatttaatagaccggatccaaaaggataaaaaatcagatcgattgtgtttgattatgccatactaaaacgggcataatgttctcatccaaaatcagaatcgtttataaaattttaattcaaaaaattttttttatattttacatatctgatacttcactgatacaatttaatttttggttcagattcgttcattggacagatcaagatcaacgagagcccgaaagaccttggtcaaattgaaagttttaatttttcttcaaaataaatctagaatatttcaattgtttaagcatcaaattaaaattttatttttataaatacgatctttttagccaatgttgcagagagtctattttttttgatattcaattaaaatttttttaaaaaatttttttttatttttattattttttttgcgccatgcatcttctttctccttcttctatttttttttttttcccatcaaaatatggcctcccactgacatgaatagccaagtaatgaaaaagactaatgcaacccaatcaacaaatgttgttctcttgttgccgtcaccattctaaaccttctatagtggcagaccggcaggttatctgacgttcttgcattaatgatgatgccccaagattacatgcactatctataatttgttgccatttctataattaaaaaaaactcatggacacctacaaaagcttgcaatattatttgcttgaatcatcgtttaacaaataaataatttactcttcctatccgatgcaacgatttgatttgagaatgttactgtttggctaaacgacaatagatatcaaatattgttacaaaaaagcggatgctagataatgcatgtgattgagaactcctgaaacaggaggcgtccaaaagtatttgtaacggcggatatattaaaaaacctcgaagcgaaggctattaaccgttacaatggcctttaacggcatcatggtaatccaacggtcactttcgattgttttgaccgttgagttcaatgacggatcgactcgacgaatccggcttgacggattttccaagagagagagagagacagacttgctttcgaagataccggcagaaattatgcgaaaagatcacggcatccaattcttggtgcacgccgttgcgacaagccaacacgattttcgtgtgaatccatggagttttgcgagagagaacctccaaaagcccaccaaatcgatgaagcccacccaatgttcgttttgggctgttcttctctgttactggctcgttatggaccaggaggacggtgaagacaaaaagtcttgctgcagcacggcgctgcttgttctttaggagggcagcagtggtcactggtcttgatttttttttttgttcttttgggggatcgtggttggtctcccgaaaagaaagccagctaatcatttgggttactccttgatggaggttctggggggaatcacccgaggcttctgaagctggtggctggtcttctacttcgtctttgagtcctggtgatccaggggcgtgtcaggaaggtggtggaggattcttatttggtttaccggggacaatagatctcaactaccatgaggcttctgaaggtgcgtttgttgcttctgcttcttttcttaatcttccactttgttttggttttttttttttttttttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgtttttgtactggagatatggaaggatctaatgatatacaggtcatctaggttttgccaccttgtgttttcgtttcattggagttgattcagattttcttttgtggtgtagaagatgaacagattttgtctttgtgatccattctagattaaagaagggttggttcacccgaaaaaaaaagggcggataggaaaggagatctgttcttcttcacagcccattaaaaaatcatctcattgatattgtgaaatgaagatctcaagtttaagaatcaaaaaaggagaaaaaaaagctttctaatggaggcgtagctatagcaccgtaggttgaccacttgaaccaacagttctgaactttttgaagatatcagccaattgcttgagtgtagatcttggtattattgcgttgtgtttaatacaaaaagttccattccaccagataggtatgaagagaaagtttcattatgctttccactctcttgattctgctttacctcaatttactccataaagataaaaatgagcctggccaaactccaatttggagtttggttttgaaggactccaaaatggttttagcgaatagacatctaaaaggtaaggaaaaaagactgttttaaagtaatatgctgaagacacaagcggcttggccaggtctagatcacttggctagattgtcagcagtgaggatctttcccttcacagtcagccaagcaaaatctgagtcctcaaaagtacatgctttccaaatagctggaagacctgccacgaagacttcatgatttaagaaacttgtagaatgattaactgtgaacaaattttaaaaataaggatgatcaacacatacttcatcaacagctaaattaagatgccatagggatgatttgtctactggtctatcataaatgtttggagaatggagacacatcacataaccttgccaggccacctattcttgcagaacttcaaatttttttcctttgcctagaatacaataaattcgacactgaagcaatccttggccttcaatatcccctgccagaagagaaaatcttgaggaagtacagtgctctaactcagatgtcttattcttcttccatggtttagttgtttgattaacttatccatatctgaccaccttcaccaaagaatttctgccatcacttccctagcaggttctttagattattcctttgtgcttttgactcatgtacaaacttccgacctaacaaatatacctgctactgattggacccaaatggttctaaagaaaaccccttctgattttatcaaccctattagttacccttctaggcatctagaaggaagataaacaatagactgcagtgttggataagacagaatttacaaatgtaagtctgccatcaatggatgttacccttaccaacctgaaagtccctcttcaatcttctcaattggtaaaaccgagtcatcttttcaaagacccttaagtctgaaaggcaagccaagatacttcataggaaaggtcctttactacaacttggtgtttttgcaagctaatctccagtctgatgattgtttccaaagtagattagaaccatgtttcaaaagttgatgcaaagaccagaaaggagttaaaaagtataaagaatacacttatggcaaatactattctaggatgaataatggattggacttcggatgagaagcgcttagtgattaagaagctagagttcaacaatcagggtcatatggggaatccataatccttgaaaaattgggattccttaaatcacctcttaaatggaagaaaatggtttggctcactatatgttgtgattgcgaataagaagccaatggctgatggatgctcttcagattcagcaccccctattgctctcattccctgatccatgcagctacatcatgatacacgaggggctccagatctaaaaagtgcccaggatctaaaatgcttttggaagttgcagtcgccatacgggcagcctaaactttttcccaaatgtaatgcgttatcccagttttttgggattgtgtgctccatacctggccatataaagtatgaacatgtccttaagttacccacctactctggatcaactccaaaaacatgattgtatcatctgtgaagtactagtcattttctggtaggcccagtgtctaacctttactctttgctagctccagtattctgtttagctcatcaattacaaggagaaaatgggttagttggtcaccttgacaaagacctcttccacatttaatccaatcaggggtttgtacattcatagtccaaagcaagaaattctgcatatttaaaatattattaaaaaaatacattgcatcatgggttgatgttcaacctacaacatatccatattcatgcctcgcaaagtttgctaggatatatcctttttttccttttctagtatatttacatgtcagaaaagatgagtgaggtgtttaccaatttgtgttacccctccatatctcaacaaaaaaatagtaataattctacaccaactcctctttacttccataactttatgtcaaatacgatccctaatttatttggatggagtggtttctttccattttatttatctaattcccattctccttgttcctatatctttacttaagttatgcccttaatttacttgaagactaccattgatttccaaatcagttatctcattccattttttccatattaaagggcgggccttggtaccatgtgagttgggtctcataggtttgaaactcaaaaacagcttctctacacatgggagtaaggctacgtacatctacctatggtctgccataccatctcatgctctctggtacgggacatactatattatattgggaggaaactggtacaaaacttatcttcgagtcggtgcaagcctcgtttcggcccatattgagccattttgccacataccatggcataataacatgtatcaagggatattgactcgtactgaagcatattaacctgtatcgaggcgtaccgaaataaaaattgagaaaattggttaaagagctattttgatatagagggcgtaccataccatactgaactggtaaggtattaatacagtatccggtaccaagattaactttgtatctgaccctttccaaaccctagtggtggaagccacgtgcactaggacacccattgttatactcttctttttttcgttttctttttttttttttacgttctttccttgtccaagcaattgaggctctcactcatttgtttagtcactctagaaagggttggaagaacattgttgtgatcctatagctctttaaagaacaaatcattgataggggaaaggatatctagattgagaggttacctttttttatagtagtgatctttttagggagtgtatttgatgtaagatcatattattttctgttttatatctttctaatatttcattcccattttgcatattctttccttaaataactgactgagactcccattcttttgctgggtctctctcaagagtctctagatgaactaattattgatcatagattggatatctacattggagcaaaacttcttttttttttgggggtgggggggggtgttacctttttagagagtatatttgatgtaagatcatattggcagaacctttttaggaaacttaatttggtatcatgttaatcttattaaaaacctcttttatattatgaatgaaatgagattttaaacaagaagaagaaagcaagaaagtttttcttagttcaatattgaagaggtgcttttcttcaaaaagaattagtttaggagtttaaagtgctatacattttttaaagaaacattctttttctataaaaaagaatatatgcaacttatatttttactgactaattgttaatcaaaatgctgctgattaattgttaacactaattcttctaaaagaactcatgttttggaaagcttataatgtcagagatcattcttttaaatacaggtgaaaagaatttttgctggctcggcctttttaattacttctattttaatgctgtcagatcattgtttttaagaacgttaaggtttctagtattgatccagttgaaagcttcatgcagttgttggaagttctattgcttcttgcatcaatcagcagtttcccatgggcagctgcagacaacctcagttgcatgccaacaagctcgaaagtatatcgaccacacagagtcacagtaactgagtttggagctgttggagatggagtgacgcttaacactaaagcatttcaaaatgctatcttttatctacagtcatttgctgataagggtggggcacagctctttgtaccagcaggaaggtggttgacgggaagttttaatcttatcagccacctcacattatgcttagacaaggatgcagtaattattggatccacagtgagttaggaacttgttccaagtttaatctgcacttgttttagtttctcatgctcaagctaaatttgtaacattcagctttttatcttattgacatggtactgaatgtgcttgttgaattcagcaatttggttattacatgcatacccattcaacaatatgcaatcactagcataaaattttgccgatgaagtatatattttttttaaagtttgtaccgaataatgtaaagattgtatcctgccaatattctgaattttatcacctgccataaaattttgctgaatcaggggtttaaatcttatgctggccatgtctcgagtttccttgacttgttctaggtttgcagacatcaattttttatgctacatttctagtgaattcagtgggatatttttatccttgactcattatgcaagaaaggcaatcatatggttatgcccatgagaaatactcaactggaaatgttgggttcatttgatgttgttagaaaaacttggtcaacttatgcaaaggggaagcacatcaggccaatttattttttgtagagtaggataatgaacctctggttgggatcaaacagtgttaagccaaattcattgtgcatgactttaaaaatttaaccatcttgggagggaaatgagagatatcaaatcattttgaataggggggtaagtcaatgttttagaagagcgaagattcccttctctcctttcttcccccttgagtaggaaaaccatgttgtatgtatatcttagctaattcttcaaggttttatctggaaccttaatgatgaaaattgagtctaaacatttagataacccttttagcatgagctgaactttgcaagtcatggaaaaaatgctccattttgagagaaaggcatgagaggacttgaatttgaatggatagagaagactctcttccatccagaattgagatgttttgttcctagggtaaagaagcatttcatcgttttcaaggttgacatctgatctgcaatgcccccaattaagtgagcatatgggtcctcccctccccacaacaaccaacacccccctctccccgcccccgaaaaaccccgtgccacgaaaaaaaaaggcgggggggtccaaaaaggaaacttgtttttgtaaggcctacaatctacatacctctgaagaggaagttttatgggctttgcccctctggtccaaggtccaaactgttatatttgcaagatcaatggtctagcaatatttgtggctaaaggctctgttgggtgatgaggagaggctttactggaactttgtcatgaacattgttctatatcacaatttgatccaatcagtggatttctgaaaaatggaataatttagccataaatcttattatcaaagatgctattcttagctttgtgatatgttttcttataaaaatatagcagagagtctttttaaattaaaaaatataaatcacgcataacattcatttttttctttttttcctacctttttttactgtccatttacaaagccagaagttttttcttcgcttttcaggattcgtcaagctggccagttatcgatccattgccttcatatggaagaggtagagagctacctggtgggaggcataaaagcctcattcacggttccaatctgacagatgtgataataacaggtttgttgattttagccagacgaaacttggaggtactctagccattgtttctgtggattcatttgggaaatgcatccaattcaggaaactgtaaccattttgtttctctgctttctctttaaatattctaaacttacaaaataattactgcaacttagttttttctctgttttcttttcaaatattctaaacatactaagaacttactgtaatttagttcctccatgttgtcctaaagggcatcacatgtttttcatctaagtttttctgtggcttgacatagactatgatttcctggtttctctggttttcacataactgctcaccaatgtttcccatacctgtttcatggatttgggacaaacaatttctgtaccaacaaacttcacaaattgtaatgttgacttctcaatttaagaagcacccagttatgaaatagtttgttccaatttagttcgtcttgaatttttctttctttatttttcatatattcttttctgattgtttctgctctagatcattttaagatggaactttgcatattaattcactctttctgatttcaataactatttctccaggtgacaatgggactattgatggccaaggcagcatttggtgggattggttccataataaaacgttgaactttactcgcccccatttggttgagctcatgtattcaaccaaggtggttatctcaaatctgacattcattaattccccattttggaccattcatcctgtatattgcaggttagttccatcaagaattagttgcctttacccatattacttgatagacaaatggaatttggtgtgcttgggaaaatttgagacttgttttgctggatgaacagcaatgtccttgtccggaatgtcacaattctcgcccctcttgattcaccaaacacagatggaattgatccaggtaagcttcactatttagaaacttgaacgattaattgatgtttttcatttttcttttaaaagtcagaagtacattttattgttaataaggcagggcgtgcaagtattgctcattgtgcctttttgtggatacaagatctccagaatcttcttgcaaatcgaaggttatattccaaatgggtgtgtgagtgaaccagctgatcttctaaatacccaatgagcgtatgccaaaaactattataagttttttcgctgccagctatctgataaatgaactttgatcttctgcttgtggcagtgcaaattcttctttctgcagggtgctgaacactaagattccaaaggacttgggccttggataagaaccaatagcccaagattcatagaaccccaagtggatggcatcaagctatttttttggggtagctatggtatgaagttgttcaattatgctcttcatgcatagacggaaaagaaggatgtaaaatattataatcttaccaaaactggctgaaaagataagctgaacatgatcaaccaagtgatatgtatatgcatggcaaatagcattttcataattattctggaagtaagcatagagtccttgaattaatatgaatagtagctagtccattgaataaatggaccatcaaatatatttgtaatagattaaagatttttcagtctcatctaatgctctagtagtgtcattctagaatattacttatgcttcattagagaaattgaatgccaacatgtattatggagttttgtagacttcttcaaccagcttaataagataaaagaattgcagtgtcagaaatatttttctattttgacgtcgttcaagttctgtttattgagaaagggatggggttggggggaggagggtgggtggtgtttggggagttgcaaatgtagtgttagcaatacctcccaagtcccaacttttgcatcaagatggtggtttttgtggatcagaatctggcattaaccattaatccaatacttgcagattattttgaggggtttttatgtcccttgtttagaaaaggccccccaaataatgtataaaatcagattcattattatgaagagttaggcctggtgcttgcagtgatgacaccagatctttgacaatggacatttgattgttagaatagccatgtcacctgagattcaaatgtccatgcaggaaagcattttggagcattaaaccaaattttcctaattttttcttatccataaaattctccattaagtttcttcttagggtcaccattcatggaaaagcttaagccacatgcaaaatgtaggtattccatacccttattgctacaagataaggaaaagaagctattatgcaattccaatgcgaaaagctattctcatggcttgtgtttagtctcatattttcgttacttatatatcggttgtacattagagagatctttagtactcaatacagggccaaggaacccaaacaatgccctccacctagctttttgggtaaggtcatggttcattataaatgatattagagcacaagcccacttggtgttggccatgtggatttggaaatactacagcatgggcccatttggtgaggtcatggtttatgcggacttagaaacactatagcatgagcccatttggtgtttagcatgggctaatcatggtgtttgtgattagatttagttggattgattcttaactgggcaaggtcactagggttaaaagggggagtacgtaaaaaccggcttgtgtttagtctcatattggttgtgtggtggagaggtcttaggtacttatactaggccaagaaatccaaaaatatgttctacctagctttttaggtgaataactgaaatttgtaattgaacaacttctgtcatttcttaataatggaaatcttgtcttgctttgaaatgatgattatgttttccagtattgttatggttttttcaatgacttcaatctgtacaccttgcacgttctctgaggtcgtggcctagggaatgtttagccatcacatggtctgtgggtttggggcatcacaatctccttccttcaatcttccatgtcctcatcatttagtgtatggccaagtacttgttagagtatgataaactcaagactgcatatatgaattctacagtgtttccagctccaaaaatctgtgtcggatacatatccgagtcggatatatactgatatatactggttatttagatactcatgaagttctttggtagccacttttaaagattggaacattgttgaacttctctaacaatgagtgagttgaactcttccaacatggagtttactcctgtaatttgttattaggagtgagtagttctttcttaagatttgttaaggatgtaggtattgaaagaactttgcaaaatattattttgctaccatccttaagttaattgggaagtttgaatgagaaatatgtatattgaaagatcataccaatcaatctcttttttaacattttctttctaacatttaaatagataatgtttaaaggtagaaatgtgtaatttagttaaacttatatgtatctatcttttttccctcttgctgagtcagacactggatacatgtctgaatccaattctcatattcgttaccctgcaatgcagatgctacatgaattaaagactgaaataagttcataatttgtaggttgtattatgtggattgagcatggactttagatgtaggcatgctgaattgcaaagcaaggcttcttggggagtcaaaaccaataggatgtcatcttatattatgatcgaggaccatggaataaaaccttttagtaagtgcaactatgggcatctaaatgaaatgggatgggttatttggtaggattacttctggatcttcaaaggagtagaaatggagacaggcaattggttgaaaagatttatctgagggtggaagttttgaagagtaagttttagcttggttgtttgatctggggtttatcgtgattgcttttgtggactggttttcttgtttggcttcctgagatgtatgagggttctacttccaagccatcctagtaatgggagaattcttatgcatggtgtatgttctacttcccacagtggagactgacatgagttcaggtcaagcagcattgccgaggcatgaacttgtagtggttgaatgttgatcgtgagtttcctcaatcagaggttgaaatggagttgtccaagtcctaaagaatgttagatatattgtttattgaataagagcggactgaatgttctttgggagtttgtgcacaactcgaggctgaatctgagtcatttgaggcccaataaatctaagatttaaaatgtgtcattgctcctgctagtttatgttcatttatttttttatttcttgtttagttttgagttcctcttggcttaaacggtaaattatgacagaactgtgataccaattctgcagtggagaggtattttggtgagagaaatttttatattcatttataatggaccaccctccttcctctaggattatgatgttacattggtgaatgaagagcacaggaggaccatcgttaccgtccaatatgaaatatcttgtatttcaagagagtagttcccatttttttggttttgctaatgagaaagattgttaaacattcatgcaattgcaggattgtgatttaaactatagctggggaagctggagagaggtctcacttgtgacttgtttcggtatttcaagttttctttctcagctctgccacttccttttttttcttctttcattttttctgagcaatatggtggtaatgtgtcacaatcagaattgaaaccatggacctcccataagacaagcccttaggaaagaggggtcaaccaacaaagctaacagctattggatctcagatctggctttgctactcaacccaagatgcgcaattttccatgtgctgtgctaagatgatacaatgcagattgaacaatcatagtgtctaaatcttatgaataaactatctaatatgtaataacaaagtaacatgcaacaattacctgagaataagcagggatttgatagaaaaatgtaccgctatatttctgttattttccattatttttctgttataatgaccaaagctttcccataaacagaaaatctacctgtcagttaactgaggacataatcaatacatatcatgactcatgagtgtacctgagaaatgggatggatccatcttttaaaatatcggcatttttaatttacaggaatgccattttccggtacctagaggaaccagttaccggttaatgaatatgaaccattctaaagcagtcagtgatgcttgccttctacagtggactattactgttactgtaccttgattttccatggtaaaacactttaggtaccatagatggaccacaaaaaattgttgatcatatacacattgatttatgcccctagatctaagcagttgctaattttctttcatttgtcagtttatagaatttaaaaaaagtttatgtccatagccttttaaaaatgtctatttatttttatatgatatttgtgattttgtgtgatggcaattctttttaatttgccccctctagttaataaaatttagccctttatactgcaagtggaaatgggagtataagctcaatctttgatatccatttaacacattttcctctgctagtggtgcataaccatggtgagaatcctcatcttctcatgaaaaatgaaaattaaatcatcaataaaatgattctaattttaaatctgtgaaattattcttatttcttcttttagaaatatctagcacatggaagttgttttagttttcctgtcaatactgacttgatgttattttatgtaaatttctgtgattggaaaaaattttggtccctcccctgcttattgtgcttttgttcttaattatcgttcttatgaatatttctagagatttgatggttgcctttgtttttacctcttgctgattggatctgaacttccactcctggatgttttttttaaaaaaaaaaataaaaaaaaaaaaaaaactcaaattgcaaatgttataggtggaaaaaaagaagtatcttataatttttctctttggatcttgatgaatattcacaatgttatacgtgaatacttcggaaacttttattaatttgaacaagaaaatgattgaaaatatttgtttcatgcgtcccagactcagcaaacaatgtctgcattgaagattgttacatcagcactggtgatgatctaattgcagtcaaaagcggatgggatgaatatggcatttcctttgctcatccaagctccaatattagtatccgccgcatcactggagaaacaaaattaggtgctggcattgcgtttggaagtgagatgtctggtggtgtatcagaagtttgggcagaggacatccacctctttaactcaaagcatggtatcagaataaaaacatctccagggcgaggtggctatattcgaaatatctacatctctgatgtgatcatgaagaatgtggacatagcgatcaggatccaaggtcaatatggcgagcatccagatgaaaagtatgacccaaatgcacttccaatcataaacaggataaccataaaaaatgttgcgggagcaaatatcagacttgcaggtcttttagagggtattcacggagataatttcagcaacatatgcctatctaatatcatccttaacgtaacatcccctcatccttggaattgttcatatgttgaaggttattccaatatggtgtctccagagtcctgtgagcctcttaaagaaatacctgaagattcttctatttgttacccagctaatcatttgaaaccacaacaatccagtgcaattcgtttgattagtcccttcattaagttcatagcaatgtaaccaaagtctggcgctgtatataagttggaacttctgtcaagggatcttcatttgtccgaaatgtttggttttgtatggtttttcaacaataaagtgtatagagttttggggtttccgtcatgtaagtaattgtatggtgaacagctatatgaaattgattttttttttttccttgtaacatttttggcaagcaatttatttgagatgaggatcttgtaagagaacagggcttgacagtcaaatgcatgagtggaaaggcaccatggccatgccataaccatgatcaataagctatatctgattttctttccacatttcattggtcaggagatggcagaagcctgtaagtttaacaccttgaaaaatgacatctttgtgtgactagaaccaattattggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccatctgctgatcagagggttgcctattccttagggttatgtatttgccttccacccaaaaataaaacttatctgacattttctttaattttagagtggtatcagtcccactataactggttgaacattgtactacatttttcatatgccaattgaccaagtacttcataaccattttatcaaaagatccatttgatcgctttgagaactttgtaccagatttcttaggctgaaacagatacaattatatcccagctcaacatttttaaggatctgctggatcaaataacaaggaaatgatcgtttggagcataactgtcaaaaatgttggtcttcataagaacatttcaaaattatacaaccatcaaattggtacgatcacctaacaacaagcatcatcttggttatcacaaaacgcaacaaccttgtggatgataagacatcactatgtagcacttccaagcaaagtagaaactgccttttgatatatgttacaagaaaaaaaaacttatattaagaagaccatgaaggttttcttaccggccttgccactaaacacacagaaaaacagcttcatagaacaatatacaagttcatttggccatgatctcccaacaacttgttgagaaataattcttccaagagtaatttctgccaaagcacaagatacaatccaactagcagcttttgatgagaaatttttgatgagaatttctcaagtgttttgacagtacgctgctgaatcgaatataaaaagcattgcagttatgaaagcaaagaacaatctcatttgggtttgtcataagcagctatgttttgaggttcacactctggactaaagaagcagaccagcagggccgacgttgagcttgctgatattgctccacatgaagcccacctgagacttctcggaattgttattcttgggcctgcaatagaatgataaccatgattaactgaggcttaaccgttcaagttcaaactcctgtcaaataaggacaagaagggccatacatatgtgaacatttcaagttaaatgggcgacaccaaagcttagtttgcaattattaactataacaaaattaacttataaaacaaaaacatgctttagaattttataccctctttggcaagccttcaatcacataaaaagcctttacaaaattttgtcccaaaacaaaaaacaatattaatacctgagagttcggtaagctggaatccatgcatatcagctcacactgaatgggttctctgaattctgataattttcacaaaagaatatccaaaaagaagtaggattgaaaataaaccatatcagttcaatcatttgaagcaagttacaattagccagatttgggaaaggatatcgttcattgtagaaccctggttgctctttgggttcaagttgatttattttagcacattacttacattaggtaaacaacttcatcattttttccattttacagctggaagaccacctaagttcaacagtctttttcttttcttttctttttttcatttatccaaaattttaacaacctaaacaatataaaaacctctggaataccatgcaatgacaagttggttcatttaacaagggtatctgataatgataaccaaatctaaggcattacgacaaaagagagccaataattgatgatgtaatattaaccaggatgatgtacattatggtcccgtcctaggatttattctgcaagcaaaatttgtcattacaagggaagtttattattgttattgttattgctattgctattgctattgctattattattattattattattattattattttgtggtggggggggaatcaaattagaaacaaccttcttttctaagattttattattttaataccaaggaggcaagctgttggagctagattcttgtgaaggaattaatgaaaagattaaagacaagtgaaaaactatacatctttaacaatacaagaatgatcatagtgccaacagaaataatttggttggtcttaattaggatctcaaacggactaatgcttaaaccatcagagcagtaaacatgaaatcaatgtcacatgaaagtagtatcagagatcaaaatttccaactgcaatgagcacagaagcagcatcactcagaagtcctaatctctttaggcaagttgtatgggaactgaattactttattcacgaagctgcatggtcatttgtaggatatgtgatgctggtgggaagagatcacaatcaaaactagactgaagtaattgagaaatggaaacgctataaaaagttgcatgtcaatctatccatctcttggttttcttattgtttaattttgtttttaatacttgtaattttgaattacagtgtaaagatggtttgaattgaggaattagacgaattacattctagggtcttcataaatgatccggaggacaaggttgtgtgatgtgagggagttgtgctgaatcaatgaaccttttccttttccaaggtaaaccattaggatatccaattcaaggtagcttctttttacatggatgtcctaattgagatagtgcaagtactagtgatcattgttatattcttgagtggatattctttgcttttctactcttccatagaaaaaatgatgatgctcaaatgtttagttctgcttagcttcagtgtgcatctttatgatgagttagataatttgtctttctaggtgttatctttaataaacttaccagaaaaagcatcatctttgatatgatatttctgtttttgttctagaccttctttttggttttgaaaagtgatgtgaggtttttgtggttctcctttcatccctctaagtttggttggtacttcttgtacccttctcattccccactaatcaactaatggtttcacaagtggtttgctgctagttgttaaacctcgaagcacaacatcttttgtgatttaattatttactctaattcctcttcagatttggtgcccattatgaaacttttattttctcaacctttcaattattctacggagggcatctaatttcaaaatcaatagtaaaaagagttcagggaaaaccaaatctaagatgcattttaagcataaaaaaccaaacccagacttcaagtcagaaaccatcttcaacaatagtctaacaaccacacttcgtcaaactcagaaaccagactttgttggaagtaacaactattttataagtagtcatatttcaacattaaatgcaccattaatcagcttatcatatctgttaacatgtatcacggtttttcataaaaacacagagaaaatagctatatttttatcatctcataataccacatcctagtttagaatttacatagatgcttctcaggctcttgcacctttgcataaacttcactcaaacaatgatcggcaaatccaccttcactcaaacatagattgcttatggtcataacaaacggccatggaattgtcaaccttctaaaccactgggaatcattatcttccaaaagataccaagatgtcacaatgattggcaaatccaccaataacgaaattttcctccactaggagacttgtgacaaatatatacccttttatgttttcagccacagcattatctccagaagatcatcgacaacaagagaaatagcactccaaaaaattaacaggtgttttccgtacctgacagaaaaatcaaaaccaacactggaaaatcaaaatgatacccatcgtgacgcttattcttaagaagtcttttatcagagctggttctggtcatccagataataagggcacagcagcgctttccatcagaaatccttcttttggtttacaagggagacacgactaacactgtctatagcatctaaatgataaagataatgactttcaatgataatgtcgacgaactcactcaataaaatcgttaattcactcagtgaagagaaatttgggaagcagtttccaaattccaacgctagatccccgaaatcttcacctttacctcgaattcccacattagtctgtcaatgggtcgatattaaagtctaatacctatccgtagacaagcacataacatgaaaaatccattcttcaaaggatgaagaagaaatcatgaagagataaaagacaaacacttacattcaaaaatcggactatgtgtgcaaacagataacaagcaaaactttaaaaaataaattaaaaaaagaagagaaagaagggaccatagtggaggcgacagaggatccagaaactcagggcgccgccgacgctgaagatgccggcggtttggtgcattagccgggagcagggtttcgcgtccgaccgcatcagctcgccatccgaccaccccagcgcccgcctcaacgccatccgacaagtcgaggtcgttcctctctctccgcctctctgtcttgcccctgtatggctcgctccgtcagccgccgcagtaggagagagaaatgcagactgtaggtatcagagagtgatgagtcagaccttcccccacacccaaaaaaaaaaaagaaaaaactttaccaaaaaaaaaaaagaagtggtgagtcagacagcggaagcggaagggggccggccggcggcaaggaagtcggatgccctcggccgcgtatcgaggtacggagtggctccggcgatccgacgctggtgcaccaggacgggcgatctgggcaggcgtccgggccggtgtcttctatcctccttcgccgccgtcgccgccgggagacttcggaagacgaggacagacacacgagaagggcgtcgcggagagatcggagaagagaggggtagaggagtcgaacggagaaacctaaagccctaaagggaccagtggagtaggagaatcgaggtggaacgttgggtaaattataacgaaacccttctactttgggccagttacaattaaccaccaaactttcattttggttgtaatttggcccatccgtccatgtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagagctctttgaatgtctttgcttgatctcttctaggtactatgctaccatattcatggtagaacacttttctagctgatcagtgaggttgttcaaattcattttgaagctactaagcaccaataatgctgacatctatgacttgttaaattataataataacaatttatcaatataattttgacatagacatactgatgtatttgctgataaaaagttaataattgatagctcttaactttataaaatttgatgaatttttttcatgattatcataaatcagatttgattacataattttacagttaatttttactcttgccatacaaattgagaaatttggatcaagttctactatatttcatcatgcgggaactaagcatacttatggttttttctaaaaaaaatttaaattcacaaattaagtgcattttgctagaaattttccttgctaatgtatctattgatcagattaaaaaagaaatcttcagcaggtgcatgtgtggtaatgatagcacaaccgtcaaccctgtcatgctacaaagaaggcatcttccttccatcattaaaatgctcgagatcaagatttctatttgtgtcatacctccagaagcctgtctttgtttataacaaaataatatgccctccacgatgcttatcgtgcctagctgtaccctcactcaacaattccaggtttgctattatcttttcaatacccctggaaatttccattgaatgtctgagaaaagacaatgttgcttgaattatgaatattttgcctccccttagaacatcagtaagtaagtatgatttccaaggttgcatatcatgtctgagcttttgcatcacatattactttatattatgataaccttgtattttccatatggtaagagatgaagtacaacattattcaattagaaattgtaaagatatgacaagaaaagaggacccaaaaagaagtgttagtttataatattacaaatgattgttcaacgttttgatgattgcgctagccttttgtctctcataataggtgaggccatgggccctatgcctgttatattatttggccagttatatactagattaaatctacctaatccctacatgacatgcaaaataagtactagattatttctacctaatcccttcataacatgcaaaatgtacatttaaggatagagaggatataagagacaaaagagaatgcaacaataaaaatagtaaacacgaaggaatttggaggaggactggcaataagtggttgtttgaatgtaccattaatccatccacagataagccatgattagtggctgtcaaccgtcttaaaatggtgagggaaaggaacaatggaaccgattgagaggggcttccaagcactcctaattccggttttctaaggtaaagactcgatccaggaggtgtttttccttatctctaaattatagggattaaagagctcgatatttcgtgaaacaacgaaaaagatcactttgataggctaggttcttctcatctttatccagaaatggaaatatacgaagtataaattagatgggcatccaaacagcccccaagagaaagggatgaaactaaaatagttaggaaaaacatctaaaatcaaaaaaaagatgcttttgatttataacaaaataatagaaaaactagatgactttgagcacatgaagaaaacatacggatagaaatacaattgtttaaaaagaaggaagtatgagtggaagttatagatgtttgaaaaaattatgtttcaattgatattcaatttgaagacattaatccttagctgtcaagctatacatgttggagagtgttaattgtaaccgatacaaaatggcatgatacatcgtgaaatgaaagcgattatctacactgctatataaagagaactctgggtgcatctagaaaaagagcacaatattgaaagccaatcattggttttgaaaaaatccaatcactttagggacatatttaaatttctacttatgtttaatttgattgaaactaaaatccagtgtcagtttggattttggaactgaaatggccgtatagaaaagttaagggaagcatatgtgagaaaacaatgcaaatccagacaggaagaaaaggaattaaaacaggtcatacagctaatcctctttatctttctatatctaaatatgctacatgatatagtatgtgcatatataatcaagttgttggactctcaggttctgccgttctgatatcgctatattcgacttcaatctgatgtgaaatcagatcctagaatctgacttcgatccagtaaggttatcgaatactttaattggatccatacccagttattacaaaataatcgagtcgaattgtcaggttttcgggtattatttgtacacctaacatggagaagatacaatttgtaatagatattcttgcgaggcaggtatcatactattcttcctcgatttaggatgttctatattatgtgagagcgtaattgccaagttacgaagcgagcacaataaacaagagcaggaaatgattgacaaaatttgtataatatggaaaacatgaagtatttatgtaaagttataaaattcattaatatatttagtatagaaaacaagaaatgtatcttataaaatttaaaaaacattaaaatctctaacctagtcaacatccttcctttcttatttccttaaaaatattcaacaaaaaaaataataaagattagttgaggcaaatccataaacaaatttctcgattctacgggtggaaggccacaaagtccaacgattggattctttctccaatcattgtctatgttttttcagaacaacaaaaagtagaagaggtgaacattttcattattctcgtttcatggggcttagcatgtaattttctaggcattgggtcatattttatggcttcatgtatatcagtaaatagtagaattattttagttaaagacagcttttgaatgttttagatttcagttttcttttcttttctacaaatggtgggactgagacacatcaggttgagagaatgagatcacatggttccttattctttctccactcgttgtctatgcttttttaggaaaaaaaaacaagtggaaaaggtgaatgttgtcattcttctcttttcatggggcctagcatgtagttttttaggcatgcggtcagttttgtggcttcatgcatattagtagatagtataatcattttagttaaaaggcggtcttagaatgttttagactttagttttctttttctttctacaaatggtgggaccaagacacatcaggttgagagaatgagatctggcagttccttctcatccaaactccggattggttatttggacgtgaatttcgcgtttcttaaaacatgttttactcttgttttcttggttttctttcctggaatccttgttggagtagaaaatttgtttcctggcattcatgtgtgagtataaaaacatgctgcctattatttaaacccaggtgtaagcttataatcatcttatcaaagagagaatgaagagggactgcacattctagacttaaaggtttgtgttaaattctatatttagaagaaatagcatatatttaatgaaattttcatgcttatgataattttggttagaaagacaatatagtggcacaaagtcagctaatcatggaacacagacttcctgtagaacagaaacacttttcctaggagatgtcctgtgttgtaatcatttctgttttttctatgccccttttctttagaatgagtacattctcggcaaactctttgttctcttttgaggatatagggtgcatcatatttgtacagtgcccactggaatttagaagtctttttctgtccctgccaagttcattcccaattttgtcagtttagacatcaggtgatttcacttcatctgtccctgaaaataaggcttcagatgcctgtaattgcaaacgagattatccacttgttagagagccaacatttcacgtatgtttttccagagttttagccatccgtcaaccaataccagctttttctaatgagcagcgtaaagcatgatatcttgttgctgaatttggtgatacactacctatagaatgtaattatcctctagtaaatttctgcaacactttctatagcgcatttcttttagcatgactacctgaccccacatacctgccctgtttatcaaaagggaaccattcagaatgtttgaaaacttatattgttttggaatatggttctttcatctctttatccatttcacttgaccctgccaacataaaattatattcaactccagtttccctgcagaaaacattaccctcaacataaatgctatttatgtattattatgacttgcatataatcatttcagtttttcacttttaattgaacaagcttcacaaattccattcaaaaaactatattaactctacagcattctctagaaaaagaaacacaacatggatgagagaggactagaaagttaatttaaattaattaaatatttgttaatgatagctaacagtgagagcaaaaatatcttttccaatgatggaaaatttaattcgaaatatcactttattgttgcattcaaagttgtgcatcttgatccattatttatccggtgactttagaaaacctgtatttaacctgtacttatactatttaaggaaaataagtactgtatgtaattcacatggaacgtgtaatgaagctcgcatggattgtggggtaaacccttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgcttatacagagtatagtacttgatgaaaccacttccggtaaatcagagcatctcactgagatgtaaataatactcgaggtgttgaaagcatttacttcctgcttcccaaagacaccaacattcacgttaataagtccatcatactgcaattcaagagtctaatagcacagccagagcttgcattcagccaccccttgtggaggatgggggtagacggaagaagaaaaagccaccaagatcagaagtaacaaccagatcggcaggatgatgttgtatcttaaatactgtagcaatccgtaatggtagcttcctttcattcggtgcgtggcattaagatcttgctgacattctgtatgctagcatttacaagcaagtagtttgccgatttttaaataccgaatacaagattttgacaagttttaaggcaaaatggaagagaaataaagaatatattacaagttttctttcatttttttttttaaaccctactcatcagccaccccacgtgcaatcatttacaggtgatccatctattttaatatattacagctttcttagtaatactgacagggaggccgaaaagttgggtcgataccatatgccttacaaaaaaatacacattacgaaaatgcaccaacgcctttttcagaacttagggttcttggttttaggctgagaatctgtagtaacatgacagcgttttaggaaggagtcaattgttttctgcttccttgggctgtccactgttttctgttttacaaggctgttgcttgtttgactggtagacacacgtaatgcatcctcctggccatcaagcatctgcgcatttaaaaatcacagttgtaagatataaaatctataaaatatatcaaaatatcaaaaaataataataataatcagatcatgtccttagatgaaaatatgcagcagaaattatatcaaaagagaaaggtatcaaaaatggtacaaaagcaagatatgtaccggtcctcctgaaaatgagatataggttgaggtacagcattggcaatggccaatgtaaatcagattggtaagcatcctgggcataattatactcctattaatttataagcctacatttgttaatattgacatgaccgaaacttgcatatgtgagtttgtgaatgaagaaggatggaatctatgtgggcttggggagagttttgatgccagggcctgtttggatacttaaaaataccagattattaggccatactgctgtatttgaacattgctgaaagctttccaaagatctgtttggatgacattttcagagtctcaaaataatatagtattagacaaaagcattggaatatcagcgtattttaaacattcacaaaaatcaccggaattccaattccaaagcttattaggctctcagctactccccctcatgccccatctttcttttccattttcattgtcacaaccagcctgaactttcatcactccccctatggcaatgcaacccctcctcgcttccctcgagtgacctgattctctcagatcacttgaggacctccctggtcttctccttttgcaatcttagatctggcagctcaacccccctaacgaacacaagccacatggccttcccctctgatgatggggttggacatgcccggcaccagtaataaggatggcgatgattgggacaggtgacaacaccaaggacggcaatagtgatccaacttcaattgatccatcctggcaccccaccatggctaacaccccagaaccccatcctcaactccagtggatcctcacctgtgtcatcattgtttccccatgttaaggctccatctcccctcaatggctgccatccaacatggttgaccctccacctcccttattggtggtcccaaccatcggccctacctcccccctccttattccaactatgactgcccccgaaccaccaccaaaccatcatcatcagtaccacaatcacctacaatacaaccaccaccaccatcttccatgcagccatccaccaacatcaccaccatttctactatcatccctttgccgtaacctctaacacatcaactttatcaccgtcactagcagatccaccatcacctacatcaccatcctcaccatcacttgagaataaggttcgtcatctctgtaatggaccccatattggtactatcctattacagcattgagtacacaccgagtgtcagtatggtacccacggatatgacaaaccttgcttaagaatatataaaaaaatgggaagatagtggagtgtagatgagaggagggatttggttgtggtaatgatggtggttggctagaatggtagtgaggggatgagagccgcaaggatacaaaaaaaaaaaagaaaagaaaaagattcctttatgaggcctgtagcctggcacatgagttcttttaagttcaaccacaatcttccatattaactataaagtctcgatacgatgggattcccctccaccctcttggtttaaaaatagcaaagatggtttagttgtcctggcggtcagctgccatgtgctgtgtttatcctattggaatcaactgggtgcccaactgaacctaaaggcatggctgcctcattgattctcagctcttgaagcttagacccttagggaggccctatttgtggctcatcagtcccagttaccaaggatggtcattaaaaatgattctcgccttaatatcaatcaagtcaagtgagcccaccccttccaacctgactgcatgattgtctcaacctgatggatggtttgaggaattgaagctgcaacatattttcaaaaataggtattgttgcaaactagattgctaatcaaactagggatctggggcaatcgtgggttttgagtgaatatgaacctggggaacaagggaattgttttgtctcatgatatattagaggtttataacatatgtagccaagggaattttcttgtctcatgacgtattaggggtctataacataagtatgtcgaccattttcttaacaaaaaaaaagcaactataatggtaaaaaaactgcaactataatgtgggacacagagagagagagagaaagagagagagagagagagaacctggcccaaattctccaatttgctttggacaacatccctgaacgaaaaaattgggcattaattcacaactgtagtactaaaactgctgcaagcataatcatctgggcaggcttaccagattatgtcatcaacagtgtcattagctagaagatagtatatgttaactgatgacgcctgagaatgcaaaagaaatggaataaaatccaaaggtttcaacatagaatgatcttataggaaattaaattattctagtcaagaaacctccagattgctaaaacagagaagattcagcaatatagtccaacattcttaatgcatgcttgggaagcccaggatgcgtcagtaaataaccatattatacattagataaattacattacatatttaaccttgatgattgatctccatgttgatacagagaccagaataacatgaaaagttaaaaatatgatatcaaagcgagagtaattaatcagtatgaaaagatgtaatagataacactacagataaatcatttacaaactgcaaaaactcgatttcttggctaagtcaaagcatcttcctggagttccatatatcctggaagataataccattctgaatcacaaactatatttttgtacttgaggaccttgcaccatatactatctgtaaggacattccaatactagtgtctgcaaactgcaaaactacatgagaaaggaatgcattaaggaatctctacctcgcttcagaaaccatatattgaaggaagcatgctgcaactaacaaaaatttagtaacatcggccctgttaaaaagctacggaataaaaattgagaagccatgaatgaacattgcagccttttgacaaaattaatactttatcaaggttctctatagaggactagaagtttcaaattaccaaacatgtaaactaacaattcaaatactacagcatgcaaataaattcatgtcttcaagaagattattgtcaatctattaaaaactctaataaacatttttgaatcttggttgcatgcacatagaacgagaaaaaaaaaatggtgcaacaacaaagaaaaaggaggcatttactttgaagacatgaaacaaaaaaataatgtcaagcaacagcaacagtgaatcaaatacttttccttatacctgcccaatccgatgagcacgatcttctgcttgaattatatcacctggagtccaggacaactcagcaaagataactgtacttgctgctgtcaaagtcaatccaacacctccagctttaatagagagctggacaatatatgttatcaaaaattagaaaattagaagcaagagggaaaaaccaagtaggaaatgaattgaacccataaaaggttgaaactgccttacaactgcagctttaatattatccttctcctgaaagtcattgactaaagcttgccttgatgatgatggtgtaccaccatcaattctaatacagctgactttctttttctgcaacaaattggtgatcactatggagcacagatcaacatttggaagacactgtcgaaggtcaagatatcttacaagcaagaattggtgtattgcatcaatcatacattgatgatgtgcaaatattaagaatttgcagtctgcctgtaaaatgaagataaggtggtcatacatacttgagtagtcctatgtaataggatgccagatatagtaccatgcaggccaacaagctaaagaagttaacaataaatagaaaaaatcacacttcgcggtcatgcaccaatttactaacagaatatattaactgaaccaccaactatatcaaatggtggtggaccagtggtgtccacttatagaacattaacaaacatcttagatgaactgtataacatcatacaataacaattgcaagaggtgaaaaaaggatccatgcaaataaaagaagcccagcctgcttctggaagtttcaaacccttaaactaaaatgtcgtcaaaggcttataatgaaaagtttgaatgacatcagtgaattttttatactaagtccatcaggatatgagcataataatcacactcgagaagccactcatgcaccatggctaacattatgacaaacttgacagaaggaaatcaaaattatatgccataaaaagtagtcaaatggcttaaaatcaattatttaaacatgaatttgacaagtctcaccacccaaaaaatggtagtaaaatcacatgatggataaatgaaaaacaattacctcaatcacggtattcaagtaatccagaattgctggaattttggcttcagctgagtcattatagatctgttgattacaaagagaaacaattaaaaatagaaaaaggttgagcatctgaaaagcaagtactagcaggctaagcagataatgattgcaaacatgaaatgatcgagtccttttttcatgctataaaaatatattcatatgcctattggtccatggacttctaaataaattcacatgatgttttaataaaaaaacctcaatggttgttgagggtccaaagatcaataagaatttatgcatgtaaagtagtatacagggttttcaatgaagtaatctaccttagaagtttaagaattaagcaactctagtgtatcaataataaggcttggagtgatagaacaatttcttattcatgacaactgaaatctgcaagtttcatgccatctatataaattcagctttttttggatcagagtacaatccatcaaagtttgaaaagcatcctcaccagctcatgatcagatgctggcctatttttaaagattcattggccaaaatggaaaacctacctccagagttacatgatggaaaacatgcagctagctaacataatacacaagtacaaagatgcatggccaaaagatttttaaattacttggacgttccatttttaagaatgccaaaaaaactgagagctcattcaataataagctcttagcctataccaaccatcctagataacaatggtcaccaaacggaacctagtacacactcaggacaccgatccacctagaagggggccatcctcataggtaatgcttggtacatacagtgggcattggtaccatacgttccatatttaagaatgccaaaaaaactgagagctcattcaatattaagctcttagcctataccaaccatcctagataacaatggtcaccagacgggacctagtacacacttaggacaccgatccacctaaaagggggccatcctcataggtaatgcttagtacatacagttggcattggtaccatactagtcatgctgactcatatgggtgcatatcgatagtaccatatcgggcacatcagtacacaagtttaggcatcccaatgcccatacttgtgccagtttcgcactaaaacattacaatacttgtcgcacgatccctcttcctagaagtatttaaaaccatgagtggtggtacctcattgggattgctgttcacagtcatgatactggaccttgtactagtaccatgtcggtacagtgttggtatgcacggttggacggtgagttcagtgtacagatatttgatacaccccctagatcgagtattggctcggtattagaaaagcatagcacgactagtacaaggcggtatgcacccacatgaagaaccttggttggtatggtgcgctcaatacaagagctatgtattagtacaaaaaaccttgatctgaagagtacgatgcatcacgtctccggcaaaaaaatattgccacaggtaaaaataaatgcacacaagtacatagagtacaaaccttgttgataagatttttttgagtaaattttagtgattcaatcttttcattggaatcacaggcttggatgttggccttgactacctccaactacaaaagaacatatcaacaccataagaatgcgaatgtaacaaatcaacagcaacttaaaattatactaaaataagaatgtctaacagatccttcccttctatgtagaaaggaatacgttgtaaatcattgacaacaataggttcctatcaagggcaatggttaatcaaaataagcttaatatgccttgcttgatttgttcccagccccaacccaattccaccacttgattagcaattcatcctcttactaacaaatatagggccctccttaacgtgaaattcctccaatcttcatccagatacgtaatctatatatcatattggtacaattactgaactcccattgatgtactcgtttctagttggaacaacaatacgaacactactacgatataaatggggaaagacattttaaggaataaaacattggtggaatgaaattggaatttgacaactgaaccaagaaggatttgacaccatctgaccagttgtatcacaaaagttagtagaaaagttcttgaagagtccaaagggaaaatatgtagttatgttcctattaaaggaacttggtgatgggatcaggtggtgaatgaagcaatcaagaataagtcaggtttaaatatttgaggcgaacaaaagacacagatgaagaactttaaaaattacatatggaaaagagctgataatgctcatttagcaacctatgattatctaaatgataagattggattgaacaagagggaaaggaaatttatcataacctaggaggaggactagaacactaagttagcatcggatacaaaaacatttgggccaatccaaggaagcccgaaatacaaataaccaaataagggagtaaaaaactgctcatgaataattgtcaaaagcataatggtgatggttgtgcccgtgagcataatcccactagtctgtctagttttttatggtatttgtacgggtaactagaagaaacaaatttttacacataaagagaagttaacatgaagtatagttgtccttgagttgaagagaaatgtgaatgaattacacagaacacaagataaaccttgaaggaaaataaattccaggaatgattatacctaagattttgcaaggataagaatagcaaataacattgtaaggattatttctaaaataattttttactacatattatttcttcttcaaaagaaaaatgaatgccaatcacaattagagatccatcgaattcatacacttataattaagcgcatcagaagtatggaaggcggaccaagagaattggtatgtaacttcaatttggcatgttagagtgttttccagtcatcaactatttatggtggtgaataaacaatatactatgaactaccaaattgaaaaggttgtcctagagaacatgtccatatacttgcagtttcaactatctcatataaaatcatttgcatgtctttgtgatccattttcaaattccaatatctcactttactgaaaaactcagaatgtggaagataagccatgtgttacgagtcaaatgtgtattctgtatattcttttataataaagcaggaggtgaagtaatacattagtgagactggagctagtttccagcaaactttcaaatgatcatgtttatatttttacacttcatcaactttgtcaggaagtatgagcgtagttgtgcccaaaaaactccgtttaaaacagtattaattaataaatcattgcctgtctgattgtagcctgttctgaagtttatgagaacatatttaagctttccaatggcagagtatttttccagataacgtcaccggaacaatgtcatgcttcaaattttgaactgtcatacaatttataattgcaaagtaagaactcaatatagaaatctgtagcatacatctcataatacactagaatgatgcataatcatttgaggacaaaattgttgcaagtaataaaacaaaattaaaagagtacttgaaaggattacctcacaaataaaaccctgatttgtttcatatctttctcattcaaatctaggaagatctgaaaagattggcaaagaatattactgacaacctcatgaaccatattataataaagtgaagaaatttcttgctaattgcagcatcttcaatccacaaaaccatccgccacagtatgctaaaaagatgcagaaacagtccttacagcatgcatgcttggggaaattgctaggacgtagtagtcagtgtttcggtgtgcttttgcactcatgtacatgtgaatgtgttggtcataaaatttatgaaaattatcaaacagctttctaatacatgagatgggcctcaacatgatcaataacttgaaacagaagtaactttccaatagaaaatgttgaaataatatactgatctgaactaattctaagtcatcatgaccaacgttggcatatgtattaaatcaaaattaaatgatttgttctgacaagccaactcaacttgacaccaggaataagctaaaatcagactaagagatgcaaaccttcccaagcttcacttgcatatgctctgtaaattcgatatgaggttcacttgaatgattcaatctcaccaatcatctctatgcagagttgcatcctccaacagtccaactaagtttctgataaatcactgactgcttccatgcaaacattcttctatctctcaagattcttctcaattatttaaccaaagcccaagcaaatctagatcgagactgtcttcaccttccattcaagataagcaaaaccacctctaatggtccccagtcatcttatcctcctctacaaattgctaacttgaaaacctccttccaagtacccaacttaaaatttgtcctatgttctaccatacataaatccctgaattgccatctgtagtattgtcatcttaagcacaaaaccttactttccccagcattgccattcatatgttgcagaaatcataaaacttttgttaaacaacagtttgatctaactggtatgtgttatcacacaaactaaaatagctccaccatcttcttaggagaagtgctcacaaccacatgaagacaatgttagttgttgttgttgcatgatcagcaccaattttaaatcctaatcctaaactaaatgccatagtagagttgttttcctataacatgaccgctggggttgggctttttggggtggggggggtcgtgggggtggtgtgggggttgtgtagcaagctgaaccaccataagcagattcattctcgtcaatcctagaccaccgctccattggaagagctctattgccaaaattcaacgaccggtaagcaaacccagaagagagacctccactgttgagtctgatagatggacaccatagagaaaatgacagtcttttcaatgagcaaaaccaacaagttcaagcgaaagtttgtcacagcatcgggaaacaaaggaaaagaagaacatagaaattatatttaacaacctgacatattgctagaaacacacacacacacacacacatatacatatatatgtatatatacacatatacatatatatgtatacatatatatacacacagatatatacatatatatagatatagatatagatatacatacatacatacatacatacatacatacatatatatatatatgaggtgggggggattgggctacactcgagtagatctccactcaaatttggccaggtctagatatgatgatgggggttccacatcgatgatttaagccgttagatgtgatctgatctactatctctaaattgtttacgcatcaaaaatcatgtgatttgaaaacaactagcctatgaatcgagtggtccaaaaatggatagtctaaataacactaaattatatatgttttttttaatcacttgatgcataggctaggggctccaaatcacatgatttctagtatgcaagcagtttaaagctagtagatcacatccaatctccaaatcacttgatgcttaatcgaacttcccaatttctagccagttcggttcaccatgcaaccattcagtttggaaccattcaacatatcctggttttaggtcttcctcatgaatatttttatcaaccatcatgaacctaagttaaatttcatgttcttaaacctaaaagtaaatctaaccgagattttgttttgaaatccccaaaaatcctattcagtttcgaagcttatggcttctttgtggtttatcaattctggtttgaagctcatgtgttgtcttcaaaagatttaaacctcaaaactttctcaaactttgggtttcttttgaaagtttggattatatataccaattttaaagtcatattggaatttgaaactgatgatttgttccaaagactcttggttgtttctttctttgaaaacttgtcatcatgtaaattgtatagttgtgttttggtatctgatacggaaattataagtttatatgagattttgaattggtattttagaatttgaacatgtgcatcatgacttgaatttttatcctgcttttgaactccaacatcaattttttcaactgtaaaatattataagtgttaggtaaagcatttggaaaatttttaatataataaaagtgaaagacttatgcgaacccctagcaaagtgttatatcagcctcattcaaaatattgatgaggtttcttcaaacccttcactaggtatatgcagcctcattcataatagcaattgggattggtacagacctttgaccaagcagtatatgtggatctcaagactttatgtggccccatctgcattagcagggaggattttatatggcctcatccagtttactggttcaccagtgactattatatggcctcatctagtttatcggggaggatttcatgtggcctcatctacagcaaggatttatgtgggcttgaggtataaaggaaacttcaaaataaggtatgaaatataagagcatttcgaaatataaattatgctttgatcatttgattttgtgtaactatcttgcttctaattttgtgtaaaattatttaaactcttttccaaagttgagtttgaacatcaaaaactttgcttttgagatttcataacaaaataatttcagtgaatttctgctcaagcttttcattgataatttgatcatgtgtgccaccttcaagtcatttgttttcgcatggacccttaagttcttttgatcatgctaggagtttgcatactaagcttcatagcttacttcatttattacacaattttccagagtgattagtgagagtgagatctctagtcgatatatttgaataaatggattcaatatttttgggatgctgacatttggatctaacgatcattgaaactatgttggtgatgtctctgcttatacctttaaagatatcatattttatagtgcaagttatgttcaaggttgtaaattgatttctaatacagatattatgagataatatactcttagtcataccttgttgaatcatgtaggttttattaaggatgttaaatatttacaatgctttaatcaacttctattgagaatgattaagtttgaatttttgtttgtttcattttggtggtcacacttcaaggtttgagcaacttcagatccaagtcatgataataagtgtgccagtataccatatgagagcctttctattctcaagcctatctccatatacttctataatatgaacgaaggttcacagtctcggtatcggaccccatataggcaaaattctactataatgtgagtatacagtatggtacgactgtatcaatatagggcggttcagtgtaccaatatgatatgatacgccccatacagtatgacgaacgctgatatgaactatgtaagtacaaaatcccctattctagagtgcccctatggtgtttaaatcttaagttctctcaattacccttacaatatttcatattaaattaagctcccatccccaattaccatatacaaaactaatcttttttttttgtgaaacactccaacctaatcctaattgaagcaagacttcttcttaactgaagaatagtatcttttgtgagtaaattgattggccctcaaggactctaaaatggatctctaaatcagttgttcgagggaaagataattataagggtgcatgcttagttgggagtggtagactcaaagttagggctgaaatctgatcggatacagattggatatcagtatatcaatatctatatgtcttttgtttggcgaatacaaatacaaatacagatactagtcggatacaaaatttcatattcatatttgttttaaacagatacatatacaatcggatactagagtatgggtataaatatggatatactaaactttatgaccatagaataaaagatattactaagtggatgataaattaagttaataacatattgatatggctatatatcttccttaaaaattcatgaatacgatataaaattaaatatggttacaagtacaattggatttttggatgcgtattggatgactgtcgatccatgtccatatccattttctttggcggatatggatacagaaatggctattaatcggattttcaaatttctatctatatccgaatagatacagatacgaaaatagatccgaacggataatatccggtccactttcaccactattcaaagtatgttgaagtggccacttctgcgcctttgccttgataaaattgggctctaattgagcgcatgattagggaccatagacatctcgagcttgtaccaagctagggcctcagctccactaaccttgggctcaatcctttgacatcaatcatatctatccctcctgatcgatatacgacccaacccaacatgattgccacccctaagctccacaagttgtgaaactaggaaataagacttggggttttatatggtcaacgaagcaaaggcgacaatgctagagctcaaagcaattggaactgactaaaatgctcaaacattctatagtgaagctggagaaggtgtggataggtcttcatgcttaaccaacaggtttgggatgagaagggaaagatttataatatgtggaagaatgtaataaagaagtaacttggaagcttaatcaacaaaggaacactaagtggaaaatatgcatcagattaggctcatgagatcattttgaaagatgcaaaagggctcaaaaaatattgctatggctaaactgatgtagaacttagaagcatatatcaaaaacaatctcccactcccatcctcttgactatgtggacctgttagagatttaaaaagaaaacattacttttataactctccgatatcaaacacatccaactcagaaaaggctggtaatctatggctatggctatggtcagggtaagccacagaaatgcaggtcaataatattacatatcaaaatcactgaaaaaagaaacacatctcctacaattgttttgactatgacaatccagtaaccattagaaaaaatgttattctcaagctcactgctaatatgcatccaagttcttgttcttgtttccaggttcttggcagttagcttcagtcacataagcaaaaaagaatatgtaatgtgggtagtgtaaggcgattgagcattcaaaaatctatctcaagcttggaagcatgccaacatggtcaactcttcatgaaaatgaaagaacctatacaaaataataactaaaaaaagactaagtattaccagcagaccgacatcttttctggtaatataaaccattttaatccgaggttgagtaaagacttttactggtaggcaacaccatgtccattattacagtctgaggaaatgtacaatagatatggacagtaactgatggaataaattgcaggtcagtggtcaatggaataccaaacaagttggaaggctggagacaattgaacccaataagagtccacattccaccccaagttgcaacataagtaatgagagacaataagtactaaaatcttacctgctgtctacgcttcactggtagttgtgaaagaacatctttttttaacctacgtatcataacagttgctttcatcaaattatgcagctcttcatggttgcttgcaccttggtacaacccaaaaaaaccctagaaaataaattatataatcatcaagtgattaatctccaatcaaactgccacaaagtcatacatgaacataggaaataaatacttacacccctacaataccgattcccatactcatgaacatttttgtacacatcaggatacaatgcctcgagctggatttaaatgattgttagcctagagtttcatatgtgcacgctaaaaaattatcataataaatacaacagcaagctagctccactatatcaggaagagtagcacctgtttgaacaactcaataggtcgcgataaagcaggagtcccactcagcagaattgcatattgagccttctgtaattgtatcaaattgcaactatgtacaattatatcaatgataaatttatgggtattgaatgacagaggggctgctgtcagttaacaaaagttacacattctaaaaaagaaaaaaagaagattaaaaattgtaaaagtggttgtgtgtaaaacaatgtacaatagcagaagagacagtccctgttttaagaagttgacaatcacaatggtacacagaacatcaactggatgagtcaaggatcgcgatttactcggactctcaagactggggaaacacaaaaatgtttaaatttgtatgaccatgagaggtatatttgtccacgacatagagcgctaccagttgacaaatattcagcttatttatatttatagcactactctgtagattaataaacgtggacccttagaaccatcatttttagcaagtcttctgatcaagtcagtctcatcacgacaataaaatctgtggaagttatagtggaaactggaaacaaataaagtaccaaagattcttgaaatgtacatgcttgcccagctttctaaaccaagcatgttcaatttatgtttatacatacaactggcctgggtgcaaagtatcacagaaacggaagcaactaaaaattcatgaacatcattttgttatgttaaaatatgtatttacatataaaatatagataaccaaatccaatataaggatggtataaaaagtatcaactgacttcaataatcagctattaaactcaaatttgtgggaagcaccaaggttgttactaggaaacaagtgagcacatgatggctgaaccaaaagcaaggaatgggtgataaagttgccttcacaaagagagtgggaagtgggaacaacattagagaacttgagagaaatagatagcaagtcactatgcatattgagcctatgccatacttcatcaggttaagctcgagatgatgtgatgagcggattaaggcttccaagtctcagcttgaagttttgcacccaaatttggttttagttaggtataagccaacctcagcctaaaccaagttggtgcatgtaataataaagtatgtacatacaaatagtatgatgttatacgatatagtacatagtattaaagaaaccttaaatttaatctcctcctcacttctccagatacccttcctctccctctcctcttctcccggcctttcttcaccattcctggacaagctacccattctccaaggtagagtcaattaacacaattctaactgcacattgactttggacaatccttgacaactgtaactttccactaatgcctcatccattcttaatcaatccctaaaatatagaaagaaagaggtgttctcagatatttatttgccaagaaattcaaacctgcagaactggcagggaagcatttgttctcttagcttgagcattcttcaaaaaatgagactcatccgcaattacaatctgaaagaagaccatcacaacttcagccattactggttcctagaagatatcatttaaaataagaaatgatgtgaagacaaagtaaaatctgtggtcaacaagaaaagtaaaataaaatttcagtatcaaatgagcgtcaagttcaacattgaaccacataaaaagaaagtatggagaataaaaccagctggagagttccaactgaaagtaactgactttaatgatatgatggcacataaaagaaccacacaaatggctccattttcatttcataattttcagcaagctcccttggtcaacttgttagccaagaaggttacacttccaaagtcacatccgatgccttctgaaaaagatttgggaaacgtttgcaaaacattaagaggtagcctaaattggaaaggttggaaaatgaggattcataacaaccacaaatagttgagacagagcttgaggattcaccatcaccaagaaatctataagcattaattctagaaatccgaccatgggtattaggataacattcaacatcctgctattacaaagtgcaagcaatcttgttttggtgaaattttttacttttttcaaaagcatgcccatcctctgatttgctctttttccacccgacaactaaaagcgggccaacatcacttaagtacaccttatttttttggtgtgtgcaaatgaagccacataaggttctgtagaacacaaaatccttccaccttaaacaccctacacagaagtgacaaatcacatcctttgtttctgtatgcccattgcccattcatcggtacatgcacgtacaataccacatgcttgagttccttccacaaccccatcatgacctctttcatctgtcattatgtttagctttctccgatcaccatcagaaaagccaaaaatccttttccaaaaacatccttgacacgagtagaaaataatccaaacagcataataaggttggcttgccacaaagcctgcttctaaatctagtctgtgtatgttgacttccctttcccaaacactaagatctacagttgcatgataacaaaaccaccacagagatccaagtcaacccagaaaatcaaagcaatatttgacatcacacagctacgtgtcatgtcttccaagagaataactacacaccctccttggttgaatagtcacgacagggacaacattagtcccaatggtttcccgcaactaattagacctccccaaaggccctggttccttcagcatgtttctccatgttcttgatttccaactccgtggatctgaaagcttacatctcatggactttttagatgcaattatgcacaaattagcagcttccaggaaacagctaaaatcatattccaactgaaactgagtttctttttgacatgcaaatggattgcattccagaattctagaatcaaagccaccaccttaaaaccctcacttaaaataaataaataaataaataaactgtgctatctcttaggatgtataaagtggctggcatctggtatttagcgctttaattttcagtgtatgttttacctgcatattatactggtaacatttgttaatttgccacaaaataaatactggcaaaggtttctatccatctaatctcttttacaaagcaagaaatgtaaagataacctgatgaaaagagattatagaaaaagaaaggtcaaataatggaaattgtatgtaggaatttttcttttctttttaacatcaagttagacaaagttacccagaattacattctacacaagaagtatgatgaaaaaatgaaaacaaaaagggaaacaagaagaaatcttaaatgaaagagaaagtatatacagaaaggaatactctaattaccttaaactctgaagctaggagtatatcctgtatcttaggaactacatcatatgagattatgttgaaaacaccatccaaatgaattgctgcctttaggtttgagtagactatcttgaatcctgccctgtttgatcctccatattgagataagaccacctgtaaactcaacaacatggtataggctccctaaaaaccaaataacaatgaaaatgtgcaatgttgaacggcatgtgagagaatgcattgataacagcaggagcaattatgagtatgaacattctcaaactgccttctcagtgtccttgcttcgagcagaagtgcagaactatgaaatttctgcttccagatgcactataggcatcagaaacaatcagaacaagccaacttaattcaacacaaccacatttgtacccaaattcaaaccatgtgtacaaccagtcatccatgataacagcaaagatgtttgctattgcaacatgacaaggaattgacttacaatgactgacaactgcttcccagacattgacatcaagaatcttttccacttggttgggacgcacccatttcaaaatcagatttcagctcctctaacagcttgtttgcacttccatccattcaaattaacaatcatgtatctccaacaacagtttgttgaaattaatataattagtatagtaagtattacatataatatagtctcttaaaaactgctgacttccagttcaagcagttctattgaaatgtaattgtcaaatgagtaaacttcttgctgcaatacttctaatcctcaaaagactggactctgtatcaactgccatttttaaaccaatcacttggaaaaggaaatcaaatttacatggttgagtgcaaaataatcgttcatttaaaaaatcatcatatttacattttcacagtagctttcattgcaggatatagtccacgaattggtattgacaggatcagtcaacagaaaatgaaagtgaagcacatttaatgccagattgactagtttgttgaactgatagatgaagcacgggaaaatcatgaagttttttgaagactcaaaaaatagaggatacaaaatggtataattagaaaatcatgcaaagatatcatcccataatatagaatagttaaaatgaaattaagtaattaagcttattcatatgctttccatgcaaaataataataataatattcagcaactccagcttcttagtaagttaagaaaatctgacagaacaatcaagtcctgaagtagaacagagatataagaatagaataaaaactgtgtattccagccagctgttctgaaagtaacttacagaactaggattttcacatgctgctatggtgcataccagcagaatcatcaacaatcacttttaaaatcaacaactgcaaagataagcctctaaaacatgcacagaaatccaaattaaggaaaaaaaaactgatattctgactcttacgatgagaacaaacttaatcatcagcagaatcagataatcatgcaagtgaagaaccacagataaaatggacagcaacaaaaacaaagggtgttctaatcaagtgctgactaccaagaatgatatgagatccaatagaataagaaagtttacgggttacataataagaacaaaacttccactgctcaacaaagcctatcatatatgttaacagttaaatgctattatttatgcaaaacaaaatttacagcacagaatgagaatccaggtttgaaaatcaaacgggaaaaaaaaatagggaaaaggaagtcaagtactaccagtatatctgatgaagggatgttaagccactcccggatcatctgcaagacaatttattaattgccaaagtaacaaaaattccattttgcaaatttaatttggtctaatacaagcattgacaaagagtgggatgatgttactaacagaagcccactgtaaacgcaaggaagatggggtgataacaagaacaggcccgtcatcgtgcatgcatgcagccacagcaattgcctgcacagagaagtgatatttttttagaaatataaagatgatttttttttcatattggatcacggtgatgtttactgttagaaatagaaacgatccacaatataaatgtgagactgcattttacccaagaaaccatctataagagtaggacttgggaaaatgattgtcgatatagacatgcaattatgctgattaacttcaaagttaaattacgaggaccaagaaaaacccaagttgttagaaaggatatagagaaacctgaatcacaaagataaactcatgttacaattataagcccacctcgagactcataaaaattgaatgagttctagcaaagaaagaaccacaaaatgatccttttttgcttctaagcatacagccgagaaccataatcaaaggagggtaatatgcatccgtaagaatgagaaagcttccatggttccaccaaaaccatcgaggttttcacatttgtcagacaaataccacatgaaagaagcacaatttttttagaggccctacaaaaaccactcttttgactcctaatgcacagttaaagatcttcggctttgttcggaaatgatgaaatctgcacaaaaagggttgacatggagctgaaaggaagtcaacactgatggtttgccagtatccaattttgaaaaaggccaataaaaatagttataggaactgcaaacttaatagtgaccttgaagttaaaatctaagagttttaagaaaataaatattctaagttagtgcatatgaactgatcaaaagtgtggtgctgcaaatgcctgtaagcctcttcgagaaaacaaagtcttccctgttccttgtgaagtaacccttgactctctcttatccggaggcaagatcattttacctgcaatgtcttcccaagacccatctcatctgctaaaagagctcgtccaccatgctgcaacacaaacctaaaacatagataattttgagaattagatatcaacttcaaagggaccaaaggtgaatattgaatgcttgcatgcagtacaacagttattatactaccataaaatcctaaagagggcttcctgtacaactttatccaagcaaacccaaggttataatgtatttctatatgcccttgtgaaacttttcattccctacatggtgatcgaatggagatcatgctataaactgagatgcttcctgttcgataacaactgaaatcagccatgacatgctgcactaacggtgggtgtgtgacacagtaaagtgttaatgcttagaggaactgctggcagtgttaggttgactcaacttgcatgtgataaagaatgaaagtttcaccatgcagaacaagcaagatttgaaacccttaacctttgcaatattgaagaatagcttagcatataatgtatattttcaccaaaaaaaaaaaaaatcttggcacagaatgattgcagaactaaaaaagtagatgcatttaacaaggtttgaataagcagatctgttgcttacataataaatttttagagatttataaatgttatgattgaagattttgaggagagaagaatcactaaataggctccacattggttcaaaggcaaatgtttaaaagcagactatttccaatctacggaaatattgtattgcaggggacatgaaatgaactacaactcaagtttaactgggtcagtgcaaggaaaaacatattttgcatcacatattattcaaaagataaagtattagttttctgatataaggatcacttccagtctaagccaccaagccttaaagctataatgggagatgatggaccaagaagcagctggttcacacccaatcaacaatttcaatatgtttttcaacttgaggactaatgctgttaaaaatattttgaacttacagaaggtttgtactttacagcagtgaaccagcaaggcggatccctcacaagtatcaaaattagcataaattcaaactcatatcaaatgcccaaaaattaattcaaaattttatttggaagtaactagaaatattgcttttctattttgaagatttttgttaacaagtctcgattctgataggactttttctatacattctactgaactgcaatataagggtaacttaatatctagcaagctgagatggaccagccatctttagatggcagccatgttgatcttaatgaacctagagatggggtgaagataaaagggcctcgaccatctgcaggaaagaaaaattaatttattttagtttagaagacttaccacttgaaggtcctgttttagttatgggtaccactgtgggtattctagagcgattagaactatgttttagattaatccagtgacctattctattttattttcttcaagccaacttagtcatggaatgctggatgatggattttgttgcaacatacaaggaatttgttgatataccacaattgcagaccatcacgcactctgattcaaactaaaagtgctttgcagaaaaatactccatttaagaagatactgctgtccatttaaatactcctttcaatgtagcacacctaacaaaaagtgcaatgcaaaaaaaatccttgatttatcaaacctcacaaccttaatcagatatacacctcaatattcatctaaataatagtttcttaacaaatcaaaagaagagcaagcatgcttcatacctaactccttctctctggaatggcaggagttttgattcgatataacttggcatcctgtcatataaaacttcccggaagactattgagttagtaaccaaaacgattgaaaaaaaaaaattacaataattatacaaaactaagttaagaagatggatgtcattcaggtttcactcaataatatacaaaaaattgtctagagatattcatgaaacaaatctgatcctgtatgtatccaaaaaaaaaaaacacctagaactgcaagtttctaccagtcacatgtcatatcatcaaaaaaacaacagataggaggaaaacataatgactagccaattttagtgtgagaaaaagaaaattttcttagttatttgattaacaaaaaatgtaggagaaaaggtcaccaggatcagttatgagctatcattcaaagttctaatttacttcttatgcctcttcacatgcttgccaaaagaaaatgaggtgaagaatggacaagcaataaaatgtcatagaaaaaagccatgcttaaacatgatacaaacattagttataatccactcataagtagtaaaatgaaagacctatgtcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatctggaacagaatttcaattaaatataagctccatgatactacaggttactatttgtttgtccattggatgtaaaatgcattatcgataccatgatatataaatggcatttgtttctcgttcattaattgtttttgttggttaaaggtacaaggacaaaatagctgaacctgcagcacatgacattccaaaatacaaagatgttacctcgataattgcaccattcactgaattaagaacttcttcagcggtcgccagggaagatggagggaacatccacagcctatggttttaaaatgacaagggaaagaaaaaaggaaaaggagttaatagtgtcatacaacctagagtgcaaaactaaacttcgaactatatcatagatgggcacaacctttcttttccatgccagctagctttaggaatcttgtgaaaagcctctacgactacctgggaaatcaatgatgcatacaagaaaaatgtcacagagatgccaccaaagcagtgcagttagaacatttgacaagttagggcagaagcacaacctgatggtaaggaaactttgcagcaatggcgccactaacatgaagatacattctgacagagagcttaggcaggtcagcttcactatggttctcttgaaagacgcacaaaaaagtacacataacattgaaatcaccaacaataccatactagcaaaaaagtcagggaacacagtatgcttaaagaatcaagatagtagttcaacacatgaatatgtgaacagattgatataccagtttctttagacatatctgatgggcacaatcttgaaggagaacaggtttctacctacgccagtgtagaggtgttagaagacagaataaaggcaatacgtgcaaaattttaatctaaagtttacattactaatgccatgttctggagcactagtaattctaaaagttgttctctacataacaaatgctccaaatacaacaccaaatctattaaaatattaaaaacaagtagatgcaaagtgcactttgcaaaggaaaagttatagaattagattttctggtttatcaagatcaacaagagaagttaaataattaaaaaaaaaaagataaataatcaagaaaaaaggtagtattggtgcagtgcttgtagagaagatttagagataaaaggagatgaaaaagatgactagtttcatagaacacttagccccttttcttgcattcagtttttttcctgcttgcaggcctggtatcccaggttcctgtcattacatccgtttaggaatcttagcctggctgcaaaacaagccaaaactcttcctgcaaaagcaaggcaagttacttcctctatctacatgattgaactcttataacaacacaaaggcccatcattctagccaaccaacaagaaagatcactagtaaatcctgtatagaccaaggccaaaaaggcagcaactgttcagccatcaagaaatatcacagttaagtgtcctgtctagactaaaactaaaaagtagtgccaggcactgaaacccaatgctgtcaacagcgaaaggtgctcgccagaacaaagcaaggtgctggtttttgagaagttcaatgaacatagtaaaaataaataccatatgtacctttcaaaaaaaaaaatacaagcattataagatagttattcaaatttcaatatcaaaaatcataattgtcttgtacagtagacatcgtgtttcacaactttcagaacaccatatcaaaataccacttgccaaatgcctcttgcttcgtctcaagtgctcgcctaggcatcacctcagtaaagtccccatgcatggggactattgagacacttaggagcttccccgcatcgcttgagcacctaggcaagcacccgaagtgcctttaacaacattgcttaaaccaataaaagaatgatcacatagttgttaaaggctcaatatccactaaggcgctgaggtctcctagagcctagatgcaagatgcaacagaagactcctgcctttataaagtaatgtgcaaaaacatcaagatacatataaaataattatgaatacatgattctaaacacattttacaatgaataatcaacacatgaacataaatatagataaagaaaaattaggggatggggtggagaagaagaggaggaggagaaggaggaggcccggttgatctttctttttggggcaggaatccccagaaacctggtcaaaatcaaaaggctatgattgaaatagtaaacatgtgctttctgtacgcaggcttttattcaaggtgcaaaaaaggcaccaacattgaggtgagtgaggcactcgaggtgcgcttcacttgtgtctggcagctggattatcataaattaggatgagaaaagaacgacaaaacagccaaaactctatgggtgaaaccgatcaagaacccgactcatttgttttcggatatgcaagcattgtaactcacttaaaaaaaaatctcatcttgatgcttctggagaacaagaaatcactttcttttcacgaatcaaacacaaaacctaggaatttcaagaatgggtgcgtaattgaacactccagagtccagacaaatccaacagaagaacccaagcgacaacctttttatagcgcgactccaagaaggttttcgagggaggctgctggaaacccttatgaggggaatgatcggggtcggtggtccgagacggaaggggggaagaggaggcggaggcggcggcggaggaggctttcctctcggagatcttcctcttggcgtcctcctcaaggaagtcgagttgttcggcgcttagaccccaatcgtcaaagccctccatcggactcccggaaccctcactcaccgagttggaagcgggaaggatgagaggaggaaaagagggggatcctggagtttttttggaggggagttggttctttttaaaagcaccgggacgggacgcttgttgccctgagaaattgttgcctacactgcgtgcatccagcgtggccgtatcacggccgctgattttcgtgatagttcattgagtgtaataccgatgacggatgccatcgtgagagatgatcaagaacactggcattggtcgcattttgcttcgcttttgcctttttggcgttgctgagacgtacgaatgctcggattatcggatgtggtttagatggagaaaatatttttaatctcatattaattataagtcaaaaaatatataatttatataaattaaaaaaaattatatataatattttttaaaaataagatcatacaattcttatcttccaattggagaatctctgtacaccgcattgtgcttccatatgcacatgaaaaatagacgatccaatcgatagatatcctccatctatctcctctatattttttttattttttatttttttcttttttttctttttcttttattttttatttttttctttcattttttctattttttttcttcctctttttttcttttcttttcctttgtttcttttaattttttttcctttcatttttttctttatcttttctttcttttttttttcttcttctctcgctgtgtaaatgagttttaaaatttcgaccctattttcattccattttctcaaataaaaccttagtacctagcatagccagtaatgaacaataacgagcattcatagtataatggtaattttttttattttaacaataaaattttagaaaaatgtcacttttacacccccacccccaaacaaccatataatagcaatatttgtgggtagtgaggccatttggcaattgacataattttttgataaaaggaattaccaaaagatcaatatacctttaccaatgatcataaacgactagtttataaggatattttaggaagcacaatagtttctaacaatctaaataagggttcgatctcaccatttctaccacaccaattcattctcttaatcctctcttactctcaatttttttttctctacaaactcttcctatttacttgcttacttataatcaattttgctcaagtatgcttgaattatctcgaagttgaaggatcaaactactagtgtcaactaccaaatgctctcatcctctatcttcggtgaagggtacatacttctcaacttaatatttctattttcgcttctagttattagtataaatagatcttgttatgatagcacctctagtatgacccccaatgaagagacgaatactcctcacaaaatcactagtgcttatgtctataagattagaaagaaaactaatgagatatggagagattttaatcaatctagcaatgcctaagatgaacctacaatggtttgcaaaaaatataaagctatcctgatccctaaatcatctagtggcactagccacttgaaacaccatatagaacaatataggatacatgatgcaaaaatctaagcccacttgaatttagttgggggtagttttagttattggcaatatagtcaagaaatacaacgtagagagcttgctaggtaaataattcacaaagaaaaaaatatttataagagccgagtcaaaaaaattatagcgatatatccaacagagtctacaacctagatatagatgaattagtaggaaaataattcatagataagcaatgaagcaatatattgaaatgagagttggatttcaaaaattattaggattcttagatggtaaagtgtcaatgacctgtgttatctggattgctaactatcgatgttctagttatatttgttgcactatacattttatagataatgaatggaatatgaataaaataattttgagttttaagctatttaaacttttacatattgcacctataatttcaaatgctataaaggcaactacaatatattatggcattcaaaataagatattatccattgcttttgataatacatctaataatactgctggtgtttctttaatgaaacaattattaaatttaattttggatggtgattgtttacatattagatgtctatgatatatgctcaacctatgtgtgcaagatagattaggtattttaaatcgcttgatcactcaaattaggaatgccatctaattcaccagtatttttcttcgagaaaataagatttcaagcaactatgcaactctcacgataagatatataaaaaatttaaacttgatgttgtgcataagtgaaattctacatatcttatattaagtgatgcatttgaatattctgagtggataaaaatttttgtaaattctcaaataccttttgaggattagtgtgttaccaaaattttataatatctgttagaaatattttttaacataataatttttttctctgatttatatcatcccactttttataaatttttgacatatattattcagattgttgaaaaattttctatatatagaaatgatgaaactttagccccactagttcgatgccaagtggcgagaatattggcttaggttaagtatcatacactctattattgctatttttgatcctagaattaaattaactggtattctttatttacttgatgaacatcaccaatacatgctaaccaattcaattagtgataaagaggcagttgaacattatttgcatgccatgtgtagtttgtatgatgtcaggtttggaggcaataaaactggcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcaacgaatctacaatatctcttatcaagacaggatttcaataattgtaatttgtaaacatatcaaatttcattttttagtatgaataaaaattatgatgcatttttttaaatattttttttgaatttttacattctctgtaattcgaataacaagtaattcaattcttaataaaaatttagagatattttttcataatattatatatatatatattttaattaaaataataataaattatgaaacttaaataactaacttgaataactaacgacctccttcttttcaattattgatttttttaattcacaatatgtttcatatcacttactatttagcctttaatatttcaattaatcaataataaattcttaaacttaaaaaaataaacattaacctaaaaatcttatttttaaaaaatttaatattaaataaaaaaaatcgaaaacaggcctgacgggcttgacatggcctgtatatatacgtgccttggaccttgccgagagggtcttgcttaacgggccgggccaggcccaactcatttatccacgttcccagtgaggcatggccgtttacttctgggctacctcccgtttatccacgttccgtgctaagtatggccgtttaggtctgagctacctctattccttagcgagccatttgtttatgtttctttaaacctcagttgctctcatgaaaaatagaaaggtaatcagtgcggttcgaggtcgaaccataggttggttcggaaaataaagaatttttcaccaccaccctctctgtcacccatccactgttgccaacaaccactcagggtcatagggttaannnnnnnnnnnnnnnnnnnnnnnnnnnnnnttaataataaatattttatcatctacaatcataatttagtagatttgagtaaataatgatcattattttgattataataataagtaatgatgtagtatttaaaaataaaatactgatcatatctcaagaggttgcacgatgaattgaccacctcatgggtaggatgacagcatcttttgcactgcattcaaccaaatagaaaaattataattactgcagttgctgccacatcaaaccaaatgggagtaattctagttgcaagcaactcacttgcatgtactgccatcttcaattgcaaggttccaaaaagctcctaatgtaactttgtttatagattaatcttggagatattttccaagccaacacatcaaaactcattttacaccttttttttgagcacattttaggtccacgtaacatctcatcttgtcggtgcgttagtgaagagaaaaggaccttttctccacatgctatcaaaagaattagaaagttttacgaaccataatttgctcaagtttggtgtggtccagcgaaataagtgcatgttgttttatccagatatgcaccaaaacataactagagatcagaaactgtcacgaaagctttggagatgttatgttgcatcacaaatggcagttgtaacatcgaacactaattggctcatagccactacgatgaccattatatatggtgagaacaaaatccactatttgatattttctttagttgttcatcaactcagaatgctgcccttgcaaatccaaggcacaatgttagtattgttgtgcattatttttaatatttagcagcaacaattgctatagtagatattatatcatgtcaaacaaaaatcgcttagaggtccatgcaaaataaaaaggggcgaaaagtggtcgataatcacattaaccggatgatgcgcgtgcttcatccataatggttgtttgataaactagacttgctcgatcatgtgatgacacatccataagattgattgataagaaatgctgctaaacaggaatttgaaatgtttctagagacgtagccctgaataatgatcagctgatcctggaagtggacttgggccatcgatcagattcatacggggcctgggcctgggcctccacactgtactctcaccttcgagggctcatgggtgacgggtcttttgattcttttcaaacggcagaggccagcagcagtggctgcaatacgacgctgacagatctttctcacactgacgcattcacggcctcctttttgggtctccattaatctcgctgtgcgaatgcaagatgcctatccgacggccaagcctgcgtcgaactgccgagttgttcgacgagcgtttcggacctaccggaatcctattaaaaaaagaagtggggtccaccaggtgatgcttcgccattctccgagacccaggattttgttttgcggtcgttttacgacatacgtggtcaagataacattattattataattagcgtagcccatttaagtctcaactgctgacgtctgataaggttggatttctcgctgctcgttgctttttccaccctttattgttgggttacctttgcctctcttcttacacttccctcagttctggctctcatctctccgaagcttagttagcaaggtatgatcttgttacgttgtcccacttttttcttggtataatttgttcagattttatctcgtatctctccaagcatgtagggatttttggtcaggcataaagccagacccacaagttttttcattactcagtcggatatttgaggactttgtttctaagcatatgggggtttctttctttttcagtgtttccatctcttactctctctgctaagtacgctctgtgaccttctcttctctttatttcttttttaattgcttttttcttaaaaatttttattttagtggttttctggtgataattttgaacatgtgatcacttgtagtttggttctctagacgttattgcttgtccgaagatttaagatccctgtggatgttttcttttatgttctcgaaaaaaatatggggatagtcttcagtttttcacatcttgtatgtaatggttttgttggtgtacttgttcaatttctgcttgatactttgaggtgggccctttaaatatcactattgttctttgatgatttatattatccaattaattgagtaaattattcattttaatttttatattttaagaaaaccatcaaaccgttcctgtactagtcgtttgtatatggatcttttatgcgcatgaccatatagcagtctacaggcggaatttctttatgtgcctttttagataattaagtaaacttttaggtttttcaaggttttatggtcttttcttggattttgacaccattttttttttccccaatcacataatcggttcaagctacatgtactttcttagcttgccagtgtgatatcttggtagatgatacttggccatgggggtaactacttaccttacataaatatcataataacgacggtaacatagcaatattacttgtgatctagtgctccttgtgattctcaaaggtctctttagaagttgtgcctgtcactaaaatagtctaacatagatcgagacatcactattatatgcttatttttcttgattactcatatctcagaactgttttaaaatttttattttcctagattgtgcttttttcctttttttttataactgttattcttattttgcacacaaggtaggcttttagcactgttaaaactatatatatattttttaattctttttgatatggtttcttttccttttgctaaagtatgtcttccaatgttctcgacttttccttgactagcttagacttcctgtgggtcaagatttgcatggactaaatgtatgactgttaatagattgcatcagtaattttttaatcttaatttggagcttcaaatatcttgtgtagcttgttccttctctcttctaattttctattttgagacatgggctgcaccccaggattcatttcaagcaatgagaaatgagtacataataaatgacagcagatagcaccaaaagttgcttttgatttgaagatcaagtggattctcttttctacttttcatgttattgatgttttaatgcaacaattccctatttctgtggcatgtgggttgctacttttctttcttttgttgaatcctttatctcatatatgtaagatctcatttcttagttgcatgcaactcatgttttgctgttttcctgcaggtgctttattaaaaatggggcatagttttgttctgttgtatatctgtttgtggactttgacatgctccttgcttctccatgcttcgtccgatgggttactaagaattggtctaaagaaaaaacacttagatgttgaaaccctcaatgcagcaaaaagtgcaaggaaagtgatcacccatatgcaaaagaatggtcttcatcgtagtctggctgactctgatgtagatatagtatctttgaagaactatatggatgctcaatactttggagagattggtattggcacacctccacaaaatttcactgtcatatttgatactggaagttccaatttgtgggtcccatcatcaaagtgctacttttctgtaagattctaggttctcatcatatagttgtctttcttgatgcaaatggatagaaacacattaatttgaaaatgtaaatccttgcagattgcctgttacttccatcataggtataaagcaagctcatcaacaacttacacaaagaatggtatgaccacttgttctgaatttatgagaatctagatattattgaaaactacatgagatctgataagcagttgcctttgctttattattattattatttttaaatatacttagttatgattggattttagaagtactctatatgctcttcctgtttacatcaatcatttggtcaaatacaatgtaacatggtgaattcattggacaacttttcattttccattgctgattttttaaatgcaatcgattgtttggtgtcaccacatctctgtttctaagcgtactatattgcttcctagaatttgacttgctagattagaagtcctgcttaatctagaatttgtgtgtctagtttcagttttaaatcatctacgaccacattttagataaaatatccacaaattaattcttagtcatatatgttctgatttgttaaaagttgtctatttgagggttccagggttcattggttcatttgatacttttcccgtccctcctttctccagattccttgttggccaatccttgctgcttgttttagaatgaaaacttcaacatttaaatcttttttttttgtcttaacaggagaatcatgtgaaattacttatggttccggagcaatttctggtttctttagccaagatcatatacaagttggagacctcaccattaaagatcaagttagtttttttgtttttttttgtttttaaattattttaaattaccttcaactctgccatttcaggtattgatgctttgtaggtttgatcttagtcccacatattgaacgagagacatttatcatatttcaggttttcattgagacaacacgagagtcgagcctcacatttattttggcaaagtttgatggcattcttggtcttggctttcctgaaatttctgttggtggttgtccgccactttggtatattatttctcccttatattagtttacttggattatatccttgaaatattttaccttatcattctttgaatccatatgtattacggtggtatgttctatgtgatgttgccaaacctcaggctttcttttatatctcatcacaggtatagcatggttgagcaggatttaattgacaacaaggtattctcgttctggctaaacagagatgcagacagtacgaatgggggtgagattgtttttggaggtgttgatccaagacatttcaagggagaacatacctatgttccagtaactcgtgagggatactggcaggtaatcccaagcagacaaagttgtgtagagaatgaacctagatccctttatatgcttgcgagttgcgtcaactcacatattttcactcatgacctctttttttccctttcttttttttttcagtttaacatgggagatttcctgattgatggccaatcaactggtaatactttcctctgtttatacatgcactgctgtcatatcatggaacatgatttttctgaacaagacttcgaaaactttttgtcatgtaggctattgtgctgaaggctgtgctgccattgtagattctggaacttccttgcttgcagggcctactgtatgttccttcaagcttgtaaaaatgattaagtgtttccaatagatgattttgttggcttttgtagatgctatattttccttctttcacaagatatctcagaagttctttaatttccctggttatttccatgttatcaccaatagtcactgcattatgcggggataatcttgtcttgaagatatatttctaggttgttgtgcagagctcatttcttttttctcttgctttaagataaagctatgatggataatcatgccaactaggtattttctttgcaaagatgctgtctttgtttgctatttcacctgatttttagccttcacattccagttgtctattcatggtctctttctgcaagatcaaattatagtttttctggctagtatctccttctttctcatgattattatgatttcctttctgttcctctttacttcatgtttgagtattccaaactcactatatctttttcctgttaacagtgttatggtgtgtcttatatgatacaatactaaaagggcctgtctgcttgggcacttggtctggtgctgaggcccacttcagcatccatactatggaaatacatatttttgccttttctagagttttggggattatttcttgttttggggcttccaagggctggcgagattgagaggtttgtattatcattaaagatagaacaacattatttatgcagggattagaaaaagtttaggactgggccctcttaaggactggggcttattgtctttctctgtataaggtacctggcagttataagcttgtaggtttcctttcccctttagttatatgtatgaacattgacagagttgtttacaatgttcaccttagagtctcatgcaagcattgcaattagctttagggcctgtttgcatgtatgggcccaaaatcgtatgggatttatggattgggcccagacaaccagctaaataagactggcttagacctataattataagaacccagaaagccgctcgagcaggcttgaccgaatcccatagggaggaaaaaaaaaagacctgctgtcatcatgtattacggtggtataattacggagttatgaatttcaattttcttaaatttttatatcttttaattataaattcttgtgagttagcttcagatgtcatcatgtgttatctaaaaacttttgctctagcgaaaaacatgattccattaattgaatacttctgatgctgttccacaatatccaactctgcgtctcgcaaaatgcagactgaggcaagaagagctggtagtaaaatcatccaagatgtgcaattcattactgcagttgtttaactgtgttgatttccttgcaaataacatagatcaaaatttatatttgatccttttaatcatttcagaccatagtcgcccaaataaatcacgccattggtgcagaaggagttgtgagcatggaatgtaaagaggtcattaaacagtatggagagttgatactggagttgttaattgcacaggtttgttctttgttttcctactcctttatcatagtaaaagtatggataactataatttctcctatagggttttcactgtcttcttattgtgatctgaatgtgtttgaatgactgcagactcgaccagatgaagtgtgcagcaaggttggtctgtgcatatttgatggagctcgatatgttaggttagtgaatcataatcattctccagttgcatgatagttgtgttatctttattttttattcaggtgttcattgtctctggtttcatttataactattgaaataagaaatataattccatgcagtgctggcattgattctgtggttgacaagcaaaaggaggaagatttatctcttaatcaagatcttttatgtactgcttgtgagatggctgttgtttggattgaaaatcagctcagaggaaataaaactaaggaacgaattttggcctatgccaatgaggtagtttgctttatagacagtaccattttatttgaatatagtgtccatagtattttaaatacatagaagtgaacatatttcaaatgctttgcagctgtgtgaacgtctgccaagccccaatggagaatcaactgttagctgtgatttgattgcaagcatgccaaatatttcatttacaatagccaataaaactttcagcctaactccagaagaggtaaggagataatatattaggcttaatcacttcaaatatcattaatcattactgtatgatctggtcatcatgttgaaattactcttcttactttttatattgagaactgtaaattgtactgagaggtggcaaaagagaaaaaaaacgcccaaatataatttatgccacaagcacatgtggcaattgttaatacttgatactaaagggtttcatgtgtaaattatgccttataaatccacctgtcttgcattttctcatgttgtttagttgatgtataattgtcatttttctctctcttctgcaaatgattctgttcttcttaacaggctatttatggaaatgttgttacatgcttataaaagtcaaggtcatatttgctttggaaactaaaagatatcaatataattttgttaattctgaccatcatgttctaaagattctgttcaagagtgtgattttttttcttttcatagcaaagtgaggtgatggtttttaccagatcaaatggtgctccgcataactcttgcctagaaattgtttgcaaggtcatatctagggctccaaacaaaagaaagatgttcatgagcatctcaggcttggcttgatgagaggcttgattgagctcatttcattaggaaatgagccaagtgcaaatgccatttaaagcttcacagataaatgagcaagcctgaacactccgggtttatagaaagaatatagaatcttgggcttgatgttaaactctttcaagctcattcttttaacaagccaggcttgagcatctactgtcaggccccactctagccctgcttgggctcagacgccctttttacatcacaatgaagaccgggaagcttattacttgggtcacagctggctcttttgtgcagctaaaattggaccaaattttgttgttaactaacctctcaagttgatattactgatgattagctatatgaacaatatatagtaaaggaagataggaatggtatgatgtgtctcaactccaacagatattgttaaatagatactttagcagtttgggtttctctcttcagtttgcagtgattttaccagggttgcttggtgtcattattgaactgaacaatacaatagaactcattgaaggagaaccatttaagtttaaacctttgtaaactctttttgtgtttattatgagaaataactctcagaagtattgctatagtccttgcactcacaaaaagtgtccttcctctctctatcaattgacttgctacctacttattttcttacagtctacctgcaaaatccaaatagatggattaaggcttataatgtattgctttcttcttctctcagtacacacaaacacataatagtgagctcttctgatattagtcctgcgtgtgaatattattgataaaaatgcttaaacttttgatcttcaattcatcataactgttcattttcttattccaattttcagtatgtcctaaaagttgatcaaggatatgcaagtgtctgcataagtgggtttatgggatttgacatgccggctcctcgaggtcccctctggtatgctgtgcaattttatttaccacattagaggatgtccccgacaagagaatataccatgtaaacacatgaattgcatgtgtggggtattctgagccttttctaacgaaaatgcttttgcatgcaggattcttggagatgttttcatgggtgcatatcatacggtgtttgactttggtaataaaagaatgggatttgctaaggcagtttaagaaggcttttcatgccttgctttgaatatatgaatttgctttagcagatttcactgcaagtgtgtaactaatggaatcaaaagcatataccatatggatgtatgtagtttcatgaacatagatcacttactagtttgtaaaatcatggtaactggtgcttttgtgtactgatgattgtacctaatacatatgttttagggtggttgtaaggtcagtgctgtatgtattggattcacggtatcatactacaaccatcctgttttcagaaacatttgaacagttgcaagttaagtgggtcaatatatcaagacacgacattatccaattgctcgcatgacaggtctagcatctaaattcattttttcctcacgaatcttgattctagtatcataaaacctgcatatggcttcctatttgaaactaattttggttgttttttgtttctacaagtggcactaagggaattcgggtcggaaatgcccatcccatttggttataaactttgagatatttctagctcgtccgcattgcaggattaatacttttctcccttggtccaagtatattattgtgcaagcttctagggtgcggacaagctgagccaagttgctcaggctccatttatatgtgtgaaaggggtgtccgagctcgagatctgctgaagttgagctaagcttagcaacaaatattcaaactttgcttgcttgttaactgaatagcttcttatgaagctcggacccagcttctatttatttttgcattcatgaaatgtgaactcggcttatttcctaagcccaacagaggctgtttagattgagccattcaagggcagcttggttcatttgcagctttattaagggcatctactggattaggacaataattgtttaatattggaagataataagactgaaattagaaacagcgctatgctctggacttaaatttccagttgttcagttgagatcggattcagaactcaaaacaaaagcttgtttaaagtgaggatttggggagagaaaggaatggtgttaagattgagaacaacataagatgaaatcaaggatatgcttttattcgaggattgagattgagactgaaatcaacatattaaataagaaaagggagcaattagacacgactacgtgggagcgaccggaagtgggatagaaactgacatcaaggctgttactgaaatcaagccaacgtgaaatttgagcaatactaagataagtataataatgtgaatggaattggcgtccaagatcagtataaaaactaggatatggatcatgtcagaaggattttgatcgatgccatgagtaatggcgtcgttgttcgcttaaaataaggttccagtatcatgatggagcatatcagaaagcatcaccactggagcgtatcagaatgagaggagcaaatcctattgttgacagtgttaattgatggctcttcctatgagtatgctttattgacgaaaaaggtttctaatctataatatttcagatagataattctgtttcttttcctaactccagaaccatctgatctcctgctgacatcccaaatgagccactggagaattataaacctaatattctctgcgggaacactaccagcatagcagaaaaagtttcagccagaggatcgttacagccatatgaggcattcatctaacaccagccaaacacatcttccataaaacacaattactgcaacgaaagcaatttctaaaaacttcagttgagcatggctcgacttttagtgtgacccgatttgtcattcaatctgacttttttgaggagacgacctgagcaaattttttcatgagacacacatacacacacacacaattaaaaaaagaagaagaagaagcaatgtttagtaacattgcattattattaggagttgaaagtaacaaaacatttttcaaattttcaaactaaaataaaggatttggattgctacatatagcatttattcaaaacaatccacaattcttataaaataagaaaataatattaaaaaaaaacacaaaaacaacccacaaagagagccgtgacatcactgattactgcatctgagacctggaaatggagggcagaacataagaaaatattgaacagataaatggttcatcatgacataccaagtctcctatgctcctacaaaaccacgctactgctgttatatagacatagcatagtcggaaaaatgctaccacaaggaaacacaatatatcacccaccactagacaaaattcaaaggacataatatgtttgtttatgaggatcacttaagctgcaaaattctctcaaacgaggaacgtttctagtctgattgcaaaattcttgtataggatgctctctctcctacatgaagtcgtgctttcaaggaaaggagaactatggtaaatagacaacttagatttaaaaagagatcagtgtcagacaccattgtgtgtgctaaaattaagaatcaacatcaatcacacatttctctccttcataagataagcacataaacaaggtgtcacaccagcaaactagaaatagaaaacaattatagcaaaccatgaaatatattgataataaagtaccaatattgtgcattacaaagaggtaacaggatgagcagtaacatgaaggatggtatgtaccatacaagatacacttcccagctaacccagctagcagaatcccctagtaaagtgctcatagaaagagaactgacaaccgcactgctttgatcaaatgaacttctttgatcattctctttgcaaaatcacaccgaagatgctgagaatggtaaggaaacagtttgggtcatctataagctgtcagacatgacaagaacgaagtaagtgtcctttgttatttttaaatcactgtacgtggaagatatgtaatgccatatagcttgtgctcaaacaagtaatggttttagcatactatggatgtgttttaggagcatgtctcctctaaatgaagtattaaacacaaactatcgtgcatcgcagtcatgctggttgccagccagcatggcatggctagtcatgttccagggcccaacttatatgacagggttgtgtgctggcctccaccaaacatcatcgacccttatgaaccagccacaggtcctcattccatgacattatccaatggcagcatacatactttaggcatcgatatgaactatgaagacaccagcatctaaagtcttcttttgaaccggtctcatataattattttggcacttcaggattagaatatcaaccttcagattcaattcctgcagaattgtaaattgctcacccaacaagtcatcttatgtagcatattgatggtttttttttttggatggaaatgtaacattcgtgttatttggagaatttgtccaaattcctggtatatccttggtggacaattgctagattcatacagacatgattgggcctccttctaaagtacaggtatgaatgtcgctgttcatttcatactccttatgacttcaaatgcattattctttaaactcctaatcacttctattcaatcttttcaaattacatcctttaatgctttactgttgtttgagagaaaacttattgctttactgttagaaaaaggattttctcctcatacggattccagccatccaaaagggattagtcctacagtctagactggtgcaactcagttattgcacacatcaaacctgccactcgatagatcccaaaagaacaagagaaacagagataagaaccaggaacaaaagccaaatgattcagcctaaggggctcaagacgaaattattattctagaagcgagcattctatattgaatttatcaagctgattcttccctaactggattatacagtgcttaaaaactttccagacgagcaagaattaggcacgcacgcgcgcgcgcgcacacacacacatatacatacatacatacatacatacatatatatatatatatatatattagtttcatataagcaacgaaacacctcatagttttatccagaacttatcaatggaaagcatatttcatcagcaacactaatgcttgcttcatcaaaaatttagtaatgttcaacaagtaaatcccccctcaattccttgtacaatttcaaatagcatcagtaagaaaccaagtgttcaaacataatgcttctgaagtgtttctttttttataatggaaacaaacaaaaactatgcatttccaaattggttttatttcacatgtaactacagagaagaggcaatagattacagaaaaccaaatgtataccacactttgattacatccagcatgtgctacagctaaattgtttacctccctgagcccatgttattgcaagaagtagccagagaggaagagcacgaaagcaagcaaaaggctgccatagatgaggaatgctttctgccctgctgtaagtgtgttgccccccaaaccaaactgctggttctgcgcaaacccagcaatctctacactcttgctctcgaagaaggacttggcggcgccgcacgtcgggcaccgccagtcgtcggggagcttcgcgaactgcagcccgggcggaattgggtaggacgggtccccgaccgcttcgtcgtagcggaaaccgcacgaccggcactcgtaaattccggtgttgagcaccgcgaaccgctcctcgaagcgacgggggtcgagctttggctgctgttcctcgggggccgggggtgggtcaggggaggggtcttcttcgggtcgggcgaggggcttgtcttctttggagacgtcgacggaggagatggcgaagcgatggagaattactagtggcctgtgggaaagggaaagggtgggagttttggaggttgggaagggatgggggaggtgggatttagtgggcttggtggcgtggaggtggtggaaggagaaggtggctctagctgtggctgaagccattgcaactctctctctctctttcgctccctctctctctctattcttttttaatctagagtttggtgtggggtctgatcatggagggaagcgtggaatccattgggaggatatgccaagtgtttggaacagaacaggggtggataaggtaggggagaagtgccggtggacgtgtgggtatttgggcggggttatgtcaccacgaggtgaaccgatcaccagggttggccgttgattcgagagcgtagcacagcatcggctacgaagatttgcgtaggaaataggagacttcgaggttacgtactcgacacgtgtcgaagatcttttgcggagtggcgcggatgctggtcctcgagccccgcggttttgggcttaaagagtccgggttaggtctttcacgcgaaagaccagccgctttgtcacggatttcgtctcttggacgagcaaatccgtgcggcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggctgatttgaccttgctcatccaccatcagagccgcaagctcagccttacgacttaaagcatcagccacttgattcatgcgccctggcctatattccaggaccatgtcaaactctgccagaaaatcttgccaacgggcttatttgggagatagcttcttctgtgtttggaagtagctaagggccacattgtctgtccgaacaacaaatcgtgacccaaggagataatgcctccatactctcagacagtggaccaccgctgtcatctccttctcgtggacagtgtatcgtctctctatgtcatttaacttccgactttcaaaagccaccggatggccctcctgaattaggacccctccaatagcataatcggaagcatcagtgtggacttcgaatggcagtgtatgatctggcaaccgcagcactggctcctccatcactaccgctttcaagtcctcaaaggcttgctgacaccttgaggaccaatcccacgattggtccttctgcaataactccgtcaagggtgcagcacgatgggaataacccgtaataaaccgtgtgatctcacgtaggttatcagattttttttgacattttcaaatatcattgtttgccatttttggtaaaaatgttgaatgagtttaaaaaaaaggggaactttcttgcttatctcaggtcccaatgaaggatgagcctggggaagttttcttgcatggaactttgttgcctgggatcaatgatggaggaatatcaaaaagattaaatgatcggttacatttcaggactacagaggaaaatatctagaagatattaaattaacatcataggaaaaatcagcatcattaaaagaataaaagtaaaatgttctgctatcttctataatcagatgtgcaagtaataagttgtaaaattttaaagattaaaatatatgttgtgggggtcatacttcctcagctgatatttttgagattcaggagttcttggattaataaaaatactaatgtaaagctcgataataaagccgatcttagtgaaagattaaggtcatcataaagtcgatcttattggaaggttgagatcatcataaaatcgacctcagtggaaggctgaggtcatcataaagccaattttattgggaggatgagatcatcattaagccaatctcatcgaaactctgagatcatcataaagctgacctcatcggaactctaagatcatcataaagccgatcttatcagagctgagatcatcataaagtcgatctcatcggaactctaagatcatcataaagccgacctcatcgaaaagttgagatcatcataaagtcgatctcatcgaaactctaagatcatcataagaccgacctcatcagaaagttgaaggccgacttcatcatgaggtagaaggtcgatctcttagaaagccatctctagcatatagcgatatcagtgagaatcatccgagtattgtattgatcaaagtctacttctggatcagatcgattgaatactgatcgggttcaatttagctcaactaaacatcgatctgagctaacctgaattaacacctgatgaagcattataatcaatttggctatctatcaatttgaatcgatgtgatcctaaaatatagatgattattatacaattatcttccagcttgctacaactatgttacaacttatcaccagctggcacatacaactaagtatgaattcatcaccggctggcacatatagctaagtatgaactcttccccaactggcacatacagtcaagtatgaactcacttccagctaataaatatagctatactctagctcacttacagccagctataacggcctaacaaattctgtaatgacctcatcagcccctttataaatagaggatcagggggatcctccaatggtaagttctgatctgccgaaactagagtgggactgtcaatgaaaactttgccagtttttgaacaaggactttagtttctacaaagttcaatctctttagttccacacaaactctcatactctattctatttttttcatctcctgttctcgaggtttaaattgacttaagcaccggagggtcaagaatcataggatctccatcgatttttgacttattttgtagattttcttaaagctatctcagattggactgctaccgatctctagctcgacttcgtccgatctccctcgtctcagattttgagccttgtagcaacagattgacatcaaaggaaggagcatttgtccaaaaattttataaagaaatgatgaatcagagagcacaaaataactctatgccttcaccgtcttctcctgaagacgtgtcgaagtagttacacctccaaattagctagatggtccaaccatccatgaactggttgacgtcaactatcatcatttgaaccatcccagttaagctcaaattagggggcttcgaataagggagaaatctcaatcaagaagaaagatctagatgaagaaggagatcacaacatccaaaaaggatgatccaaacaaggaaggatgttgcaggatccagataagaaattatgaaaatctcttagtcatattgaactcttattttctcatctgtacttttaaattcttgataggatcaaaaattaggagggagatttctctttgcacactcatcagtaacgcctccaatatgcttggacaagatctagttggagagcctcatgaataggagcaagctcaacacccagcaaaagctttttggtcacatcgtcttgtggatggggccgaggtccgtaagcggtcccttgttctctcgcacataccccacttcggatggtatcgagattgtccgcacgaggccctgtgcatggccatccatgcattgactctcaagccccccaaaccaaaacccacggtggataatgcgccatgttactccttatgcttcattaatttccaattgcgcactgctcattgcgcacgtgctttgaaagttaagatggctcccctcttttctcactcgtcccatcccatcacaagtgacaaaaaaaaaggctccaacccccatcagaaggttgagcttattaaaaagccgacttcatcagcaatctgacctcatcaagagaccgatttcataaaaagccgacctcatcagaaagggatcgatcccatcaggccgacctcatcaaaaagtcaatattcggatcgagcttaaactccaaagggcaaaaatgatgaaaattcgatctccagattggtaagccctgaaaggtcaagatggaggtaagatcttataatcaatgaaaattcgatctccagattgataagccccgaaggaccaagatggagataagattttttgatcgatgaaaattcaatcttcagatcggtaagccccaaaggatcaagttagagataagatcttttgattgatgaaaaatcgatcttcgaatcaagtttaagcctcgaaagggccaaagcaaaaaatactgatatttggattgagataagtcctgaaaggatcaaaatatgatctctggatcaatataagtttccctaaggacctaaataccgaccttcggatcagtctcgagaagacccaaaacccgatctccggattggtaagcccagaagggctaagatgaagataagatctcttgatcgatgaaaattcgatctctggatcgataagtcttgaagggccaagatggagataaaatctcataattgatgaaaagtcaatctctgaattgagcttaagccctgaagggtcaaagcaaaaaagtcgatcttcaaatcgagctgaagctccgaaagggccaaagcaaaaaatatcgatttttggatcgagatgagttccagaggctggctagttttcagtctggctttgctgctccatcttcgattctatatctgatccaatagtgagctttgctcccattgattctctaggtcctcctttaccgcttgaccctgtgaagctcatttggttgaataagggactggtcgaaatgaccaaaattcaatcttcagaccgatataagtccccctaaggacctaaacatcgaccttcggatcaatcctgagaagaccaaaaatccgatctctggattaaatctcataaaatttcaaaatcatgattggaccatgagtattcaaagtgaaacatttggtctctggagtggacttcactaaaattttatgcagaaaaattgatctccggattggacttcgcaagtctcgaaaagataaattctagcttaaaatttcatgtgaaatgccctcgaaagagaaggagataaaaaatctcaagatgaaacttttgatgcatgagagacttgatctacccataatgatatcggacaggatccaagcagttgacttgaagaagcaaatggtacagatttgccacatcggacaagttgaaaacttttttcttggactacttcttttgtccaaaacaacttctttggactcaaacgcgcaggtaagtattatgggaatcataccatctcagctgatgtcctcgaaactcaggagttctcagattgataagaatactgatataaagctcgacagtaaagccgacctcagcagaaggttgaggtcatcataaagccgaccttatcggaaagctgatgtcatcataaagccgatctcatcaagaggctgaggtcatcataaagtcgatctcatcgggaggctgagatcatcataaagctgacttcattgagagctgagattatcataaagtcgatctcatcaaaactttgagatcatcataaagccgatatcatcgaaaagttgagattatcataaagtcgatcttatcaaaactctgagatcatcataaggccgatctcatcagaaagctaaaggctgacttcatcataaggcagaaagccgatttcttagaagccatctctagcacgtggcgatatcagaaagaatcattcgagaattatattgatcaaagtctacttctgggtcagattggttgaataccgatctgattcaattcagctcaactaaacaccgatctgaactaatctgaattgactcctgatgaattattatgatcagttcggctatttatcgacctaaatcgatgtgatcccaaaatacagatggttattatacagcagtcttccagcttgctatagctatgttacaactcatcatcgactagcacatacagctaaatatgaattcatcaccagttggtacatacagctaagtatgaacttatttccagtcggtatatacaaccaagtatgaactcacttccagctaatacgtatagctatactctagctcacttacagttggctataatagcctaacaaactctgtaacgacctcaccagctcctctataaatagagggccaaagatcctccaatgataagttctgatctctcgaaatgtgagtgagattattagtgaaaattttgtcagttcttgaacaaagactctagttcctacaaaattcaatatctctagttccacacaaacaaccctactctattctatttttttcacctcatgtttttgaggctcaaactgatttaagcatcggagggtcaagaattggaggatcttcacttatttttgactcattttgtagatttccttgaagccatcgcagatcgaactgctatcaacctctagcttgacttcatccgatctcccttgtctcaaattttgagccctgcaacaacaatatgaatgtggaaaagataggaaataatacattttcttgaaagaaatccaagattgatacataaatgtagaaaatattagggactaatatataaaaacctaaataatcataattttcttattcgtctagtagataatcttgtttgttcaatttgttcatataaatgtaatatgacataaaaaagatttatagcaagtagatttttaatttataattcactaaattgtggatcttagttggatttatgatcttttttttatacaattagatggtcacatcaatctagtgcgagaacagttcaaaagatcaagatacacaaaatcgcacaagaccgacgggtaatccttaccctatctccaaatccagatactagagtgctctgcaacaaaggctgccacccagtctgatatagcattagcctcttgataggtatgctaaactctaactgcaacagtttgacgaagagaggtccagacatcccagatgagaggatgggcttcgagctgcctagcacctctctgaatccaaacaatgactgtggcaaagtcactctcaagatagatcctctctgcatgaagctactgactgacaaaaatgacacctacccagacagtatgaagctctgcaattgggacagaaggctcaaaggggtgggagccaccagccactataagtctcccatcagggccatggataacaaagcctgctccacctctcctgtccctgacacagccatcaaagtttaccttgacaaaccccaaggatgggggctcccaagagatggatagaaccttacaggttgttgtcagggcagccagggagctccaggacctggggatatcgagggacggagtggaagcatcaaactggtagtactcctgaaccagatagacagctctatcaaaaactcgatgaataagaatcatctcaccgtcgaagacaagactgttcctcgatagccaaatttgatgagtaatataagccatccacccaccaacagcagtcgatccgttagccacactctgatgaatccagtcaaggaaggaaaccagccatagatcattgcttgcctcccacgggtaaccattcgcctgtctccaaatgaccctcgtcttaggacagtgcagaatagcgtgctccgtacactgtggccgactcagtatgcgaagcgaagtatattgcggcatgtaatgctgcaaaaaaaactatgtagctaagaaagtttatcatcgagcttggagtggcaccctccatcgatgatccagttctgctttattgcaacagtactggagccatagctcatgcaaagaagtcgaaggcacatcaacgaacgaagcatattctacgtcgctataccttatccgagagatcatgaatcgagatgacgtcgacctttagaagatcgacaaaaaaaaaatttggctgacccattcactaaaatctttatagtagaagagttcgaagatcataaaataaagatggatatacgttactataccgattagctttagtacaggtgggagttattgagaaatatatctcaaagtcaatcgtcagtctgttgacgattatactatttgatgtaattgtatatgaattaattattaataaaatatttattgaataaattttatcataagcttgtacatcttctatatcgaacttttgtgttatgatgaaagtccttaagactattttaaatcgataaagaaagatttatcgtttagtccttaaatgagttcgtgaccaaatgatatattattactaggatgatagacatatcaagtgtaggttatttgtgccatataagttgattatcctcttaactaaggagtatggagatgctggtatggcatgcaggtgaaatatagaagtacattttattgaatgtgagcaactctggagcactctgctgtcaagagttattccaaaaagatatggatataagtgtccctctgatctgagatcatcacggtgacttacaagtaactcactgtgctttgatgccagactatctgaatttttaattcagaatcgaaagatttctgggcacagtccagtacttgtgaagttggtacgtgagtcaagatagaattgaccactccaagggattggagagaatactttgtgtttcaatttagtaagaccttgatcaggacagtccttgtgagaagtcacaagatttattaggttgagacacataatggatgtactgttaagagttaacagtttaaactctaagttatcctagcatcaagggtcaaagagatgaattatacggtaactatatccaagtaagttcttgagcattgctttacatacattcgatctatccgaacgtcgggtaccattgctagatagttactccgattgatacagaaatctgtttctgtgctaccgacttaggttcgaatctatggggtcacacacattagaagttcttctccgatcggatggctactttggtgaagagtcccactagacggagactttggtgaagagtcccactggattgggactctatcattaaagaattagttagtgattaaattactaattagctcaatttaattgagcattaaagtctggatcaagtttgattgaattggattcaatcaggtcaggtctgattaggttacggtaaaggagaattgatcttgatttgatcgggtctatgactacattaattcactgatttaatcaggtttaattgaggttatgggagcctaaatagattaagtttatcatgttttatttggatctaattggattgggtttgaaagaaattcaattgattaaatcctagaatctcagatgaattggactctctcccttgtgctacccagaaagacacaccttttctcatcatacaaaacaagtttgtacatgagaaaatcagaagctaacattctttttgtcagccactttggataggtattagttgtttgggttggagttcaagtgaaactttgaatttgaatcaaacttcttatcctactctacctacccaccggctcttgtgaaggtgcctattttgtgtgacaaaagaaatagcttcaggttatttttcatgcccaaaaccctctggttggcctctttttaggtcagataagggtgagaaaaagttgagatttaattgaaattcaaaatagtttgaattgcaacaaactctgggtcttatcctatctaatttgataatgccggcaatcagaaaaagcttatgcttttgtgcgccatcaagtctctaatttttaccatgagataccagagaaaaaaaaaggtcgaatatccttcttggggcatgaggtttggggtgggtttctacctttttggcgtgtgcaaagaaggagatctatctcttctcgggtgagagacctagaatcattttagggttttagggtgaggaaaaaactaaagagaagagagtcttcatctaattttcctctaccttccagcaaccttctctaatctatcttcgacatcgaaaaaattcgagacgatcgaaaaaggacatcaaactaaatccgccatcagaagccgactgcgcgagctagcacttctgcagagggctgatcgatccgaggacttcgtatgaaccatccgtagagattggatgcttgtgcggctgtgagtaaccaacgaggactttcagatccatattctcgatcgtaaagttcgactacctatgctcagatattgggttcgaaattttcattgtggtagattagatttatcacagtgtgctaatttttattcacatgcttattattttaaatttatatttttatgcatgtaaattcatgtcatatccgtttgtaggaattttaagatcaatcttatgtatgctgttgggggatacccaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcggcttacaacgccatacttggacgacccggattgaacgccctcaaggcgatcatctcgacgtaccatctccttgttcggttcccgaccaaaaatggaatcggagagatgcgcggagatcaacagctcgcccgacgatgcttccaaatcttcgctcaaagcgacgagtcgagggattctctgacgatcgacaagctggaccaacgggaggaggaagaacgaggctcgctggccgagtagctcgaggcgatcccgataggagaaaatcccgacaggaaagtttgggtcgggtctcaattgcccgacgccgaacgacgccgtctgacggagctgttgacggccaatgccgacatatttgcttgatcgacagcagatatgtcgggcatccccgcagaaataataacccaccgactcaacatcgacccgacgatgagaccggtgaagcagaagaagaggtccttcgctccagaaaggcagagggccatcgacgaagaagtggacaagctactcgaagcaggcttcatccgagaatccacgtatcccgattggctcgccaatgttgtcatggtcaaaaaagccaatgggaagtggaggatctgcatcgactacaccgacctcaaccgagcctgcccaaaagatagcttcccgctttccaagatcgaccagctggtggatgcgacgttcggatttcgactgctcagcttcatggacgccttcgtcgggtacaatcagatctggatggtgcctgaagacgaggagcacaccgcgttcgtgactcccaagggcctctactgttatcgggtgatgcccttcagactgaagaacgccggtgccacctaccagcgacttgtcaataaggtcttcaaagaccagatcgggcgcaacatggaggtatacgtggacgacatgctggtgaaaagtatgcagatctcggatcatgtttaggatctcgaggagaccttccgcacccttcgacgacaccgaatgaagctcaacccgaccaagtgtgcttttggggtgacctcagggaagttcctcggattcctcatctctcagagagggattgaggccaatcctgagaaaataaaggcaatcctcgacatgcgtcatccgaacaccaagaaggaggtccaacagctgaacgaaagaattgtcgctcttagtcgattcatctctcgatcagctgaaaggtgcctaccgttcttcaaaactctgcgccacgcgaatggtttttcttggtcggatgaatgccaacaggccttcgaagacctaaaaaagtacttggcttccccgccgctactcgtaaagccgcaggtcggggaaaccttgtatctctacttggccacatctcctgaggcgatcagttcggtactcgtccgagaaaatgagtgccgaacccatcagcctatctactacaccagcaaggtgctccacggggccgaagcaaggtactcagagacggaaaagatgattttcgccctgaccgtctccgcgcaacgactccgtccatacttccaggcccacgccatagtggtgctcaccaaccaacccctgagggcgatactgcgccgacccgacacatctggatgactcgcgaagtgggcgatgaagcttagcgagttcgacattcagtaccgaccaaggcctgccctgaaagctcagatcttggccgacttcatcgccgaatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatttttaaaatatatatataaaatttttatacatctcatcatccatgatcttcaaaaattattgaatgagctctgtcacctcctccgatgacatatccagcgaaactcacatcgttcgcccttgcagtgcctctttccagctcgtcttcgattggataccattttttgagatacccggtcgttctctcatcttcttcgcgatcgtccatcacatcgacgattgcgatagctaatcaggtcaccggcgaccacatctaagaaaaaaatagcccgaatctcaacgcactacgctcaggttgctcaggtacagaaagagccgctctcatttatggcctttttgaccacaagccacaacaaaccttttttttttttgagagtactacaacatacactcgatacggctggtgctattcatgtgcgcatgttgttggaacccactatctattttttttgggtaaaaagcccattatttttttttttgccactcactgaccacttttcgcgtattatttttagataacaatgattactaggatagtaaaatataattactggagttgttattattttatttttatacaaaattatattaagagtctcctttaaaacaaatgcttattatattggctcggaggaataattactggagttggtattattttacttttatacaaaattatattaagagtcctgactcaactcctctaaaactaatgcttattatattggcttggtggaataaataatttggatatatccgggtcattgaaatttccctcttcgttcagggatttatccggaaacggcttcggaccctgccatccttcttctctctctgtctgactcacaatcacgtggcaccatgtcaccgctacctgtacgtgtcatcgaaattgacaccaccaacatcttagccgtccgatcgacaaattccaatcacatctctggttgaccaatcgaacggcccacaggaattgttcctttggttcgaaaccatcaatccacacacccttcaccacggaggcccaacgagtctaccatacaaaaacacgaaattggagccactgagatgagatcgaacgggtctggttaacgattctacaccgactataccgtgtatagccatagaggtgggtaatagtaggagtctttctgaccccgtgccaccgcgttcaaaccctaaccctagttttaacccagatctctggatccagacccaaagcatcgttggccaagtgcttgagaaaaagccgagaagaagtcatgccttcagctgaagacgaagaggagcgcgccttcttcgacgacgacgacgacgacgacgacatggagggcgacgacagcgaggaggaggaagaggaagactacgaggacgacgatgctgaggccgtgcagccacctgccttcgccggcgtggcagtggcggccgcgcctcctctcctcgcgaagcccgcggaggagggactcaatggcaccaccccctccacatcctcctctgaccgcgccgccccaaacgctaaccccccctcaaaccctaaccccaaccctgctaccgccgcagatcccggcttcgccccgcagaacggcgccatccctattcttcccctctctgccgctgcgccctctactcccgccgcgacggcggctggtggcctctgcacgccatcctcctccgatcccgtcacccagccgtacgaggacaggaagccgttccccgtcgcggtcgccgctgtcggcggcggatacgatgactcccggcggctcttccagcggctgtggaccgacgaggaggagatcactatcttgcaagggtttctcgagttcacttcccggcgcggcaccaccttcgcttcccaccagtacgacaccggcccgttctacgaggagatcaagaagcggctccagctggagttcaccaagaaccagctcatcgagaagctccgccggctgaagaagaagtaccggaacgtcgtcagccggatgcggtccatggggaaagatttcgcctttaggagctcccatgaaaaggacatctacgacatagctcgcaatatctggagtgccaatgtgaagagggctcgtgacagcgacgacgacgatctcaacaccccgaacaatgcctatgccattgaagccgtctccgctcccgatggagccatgaattcagacagacggatgtcaagatcacggaggcgtttcagaaggagaacagcagaagcggcaacggcaacggcagcatcagcaagccccgcaacagtaggggttccggtagggaactcggtcccggtaacccaagtgccttcgtcgtcagctgctgctgcgatcccgggcatcatcgaggagacggtgaagagttgcctctcaccgctgttcaaggagctgatatactcggcaaccggggggccgctgggtccaggtctcagtggtggggctggtttattggggctagggccaggaccagggccagggctaggcggtggtgcagcggcactgagcccaataccattctgcctcggcggaagcccggcaagtcttccaggctcaggggcggcggtggatgagaaatggaagaagcaacagatcctggagctggaggtgtacttgaagcggatagagctcctgcaagaccagatcaagtctacgttggaggagctcaagtcctccgggagctgataagaggtttcctttcagaacttgtacttcttaagttgtggatctgatgttttcattcgtaattattagtttggataattctgtcttgttaattagaaggtacagggactctggaaataactatcctttcttctcttttagttagtagtaatctccattcagtttagttacttttgacctgttactctacaggaaagattacctggaggaataggttgaaagaatttgcctgcattgttctctactacatcatcacttatgccttgtaataaatttgccatgtgaatacctgtagtcttagtcttagatgcttattgtggatcgttatgttagagggatgtgtcttggtcggggaaatttctttttcaggtggtataatattatattattttatgacaaatgaaaggagttattcatgttcaccatggtccagcgaattttgagcaagtccataatatgctttgacggagaagagtcgtctaaattagatgtgaaggtgggtgaactagtgttaggtaattgttcttaatgcaatggttcacctctagcctataactgtagtgtctgaaatggctgtgggaggtatccttggagggtacaaagttcctcccttctacatcaagaattaatccagaatgcaacgtggaaggaagcttctggttgttataaatctatcatgacatctaaggataaatacatagtatggacatgggtgcttttggcctgttgatttttgtaaatggaaaggtaaatgctttgaagcatgcaatttctgaagatcaagagtataaaacatagccttgaagcaattcagcatttgatgtcaagtggtcctcaccctaagttttcttaaataatttttgatgatgaaagtgcctttttttttaatacttcctagatagtaatatgctttgcacatgaacatgtgtacctttagtattcatttacactagttatttataatttacttctcactacactgattttcacattatgttaatacatacgtgtgtgtgtgtgtgtgtgtgtaatttaattttatatcttttcaataaatttttatgagttgaagttgaaacatattttgttccatggatttttgcttctctatttattttttattttttttgcttgaatatgggctaactaaatgaaacaacctgaaatagttcctagtaattgttagggttctttggaaaaagaatatcattgaacaggaattctaataactcattgggtgggatggtggaatgagccgagaaataattgatattcagagaggtcatggattgacctatgagtgaaagagtaaagggtcactatgtgcccttgaaagttgaaacctttatttattggattacaatattttggtatgagttggcggaagtaaactaaggattccttgtattctgaaaaaagaagcatcatttaaatttcttattcttgtttagcttctaaatcatgtttttaattatctggttggtgcctttatatttaacaatgagcacttgagaaactgtgtagaaaagagattttcatttatttttcatttttcaagtcaattatatagcacgagttcatgttccggaatgtttgttatctaagaggaattctggacaaaaggaattatttgtctagagttgtcccagtgggcttgttacagcaattctttttgaagatgctggatgcaatttgtgatttcaagtccaagaacttttaagagaatgtttgcatgtcttctagacgcaagagatgtattggggtttttaagagaattttttttttttaaggagacagaagatgctagagtctatcttctattctttgtaatgccaaacacttgggacttggctccactgccgattggactccacttttatttcatctctcccaccggccacgcaagccgctagcaacccaccagagagtggatttgtcggattttggctcaaacctatgcagtataatttatctactcaatttttttttttttggactgtaaatacaatgttcacatatacggtgagaattgtcatatgcttatgctatttggcatttgaatattctactttatggatatctgcatatttaatagtaattggacttctatcagcttatcatgcacttggatacttcttatactgtattttgattcatgatctaattctttagcatctttattgatttctgaaattgtttaaaatatttttattaattcaaactttcggtccaagaataccaggaccatccgtttaatatctccagactatccaaaatactctaaaattttgtgatagcttgcttctattttgtgctatcattttttttgttgtgttttttcttcttattattttcaaaattttaattaaacggtggtggatgggaaagttgtaagttgtaatgacagtattagcaagaggcatatgtgcgtttatgataatgattgtgctttttttatgaaatatggaggtgccgtgtctggttttaggaaatattatcattcttctataactcaggtggtaatctgtggattggattgaagagtgtgttcgccatgttgaatgggcattctcatattggaaagtatcaagtaggttgatgtttgaatgtataactttaggatattaattatcttaaaaattattaaaagatattaagatcttggtctcaggaagttggcagtttcgcgttttaaaaagctgagacaatgaggcgtctatggtaagtcaatcactgacaaatggataggcaagtaattcatttgatctggtagttgttcattcgattgatccgagctaaatgccatctcggtgcccaaatttgtttctgattataaattctagcatatcgtagaacatgttctttggaaatgttttatggaaattatggccctgtgacgggtccaacgagagttaagaagctactagaagggtggagctgcacaaaggtgcgtatcctagtgagggttagcttcggaatactttagctaaaagtgacacacgtgcacgaattaaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaggacaaggcccctggacttaacgatttccctccactcttcttttgaaggtattggcctattattcatggtgaggttgtggctatggtgcagaagttctttgcaactggtcaaatatcggagctctagaaccagacctttattgctttgttaccgaagtgacaggatgtaaccgaatcgggccacttcagcccgatcagtctatgcacaactatgtacaaggtcggtaactgatggtatgcagattgaagcctgtcctttcatgattgatctctccaatataggatacttttgtgggtggttacggtatttcttacaattttcttatagtacagaaattcatacatgatctcagtcgtgccacacttcaccgcagtcttatggcgatcaagctcgatacggagcgagcttgtgatcgtatcagttggcgcttcatgaaggaggctctttcggattttgacttccatccctattggatagattggactatggcatacgtttggagtccatcattttgtatcttgattaatgggatgccatcagagtttttctactccactattggcctgcgtcaaggttgcctcttatctctctatctttttattatatgtgctgatgtcctttcgcgagctcttcgtgctgtctctcttgggacgagcttggacccctatgttcctgtcctaggggtttagccaatattgcatcttctatttgcaaatgattgcttgctgttgggatgggccacgttctggaatgctattggctttaggaggattttggaggactactatggtgcctcggatcagaatgtgaatcttttcaagttagcgatactctttagtctgaagatatcggtgcaattgcagcacttgattcgagatcggttaggtgtggccgagcataacggggttcttcagtatttggggattcctatctttggtcgtaggttgaggatggcggactgtgttggaatggagcagaaagttcgagagcgtctggaaggatggtagtcccgggctctctcgatgatgggtaggattatcttgatgaggtccattctcacttctatgcctgtttatttactttcgaacattattttcaccaaaaattttatgagcaagcttgagctgcagttctggcacttcttgtggcgttccaaatctaaagggatggtggtgtacatctgctagcatgagatatggtctgccaactagtatagaaggatggtctaggcatttagtccttgattacaaggcgggaggcattgattgctcgacatactgccaagcttctacttgaccctgagtcgatgtagagcatgatgatgcggcgaggtacggcatttggtcgaccagtggcaagctacaaatcaatcatcgtgcttcagttatatggtaggagatctgtgtgcatgcccctaatgtgttccttcagactagatggttagtgggtgatggtcattctgtcagtattttgcttgatgcatggatagccgacatcccattggttcgttggccgacatatattagtacccaggtgatcgaaactatgagggtttgtgatcttctccacactaacggttagggttggaagactgatgtggtgattagtctttttcgagaacttataggccgatgagtactgaggattcctacaccttttcatcatggctcggatgttagggtctggcaatcatcctacatctcgaggcctgtgatggttgacctctatcgactatatcatcaggagttgaccaggcatctggatggtggatggatttggaggctcggagtgcacccgagagttaatcttttcttgtggaaggtagcttggagatatctttcgatcaggtcttatttgcgtgagagagatttggataccagctagagtgttcctgctgtgctagggaggaggagacgttggcacactctctcttttggtgcccactgaccagacatatctggaggatggttggtttacatcatcgcgctgttcaggtgggtgatcctgttggggccttcttagaccgactaagatcaagagtagggggtgttctattccacaatgtagttatcaatgctgcatatattgcctagcatatttagctgtctaggaacaagctggtttttgaatccagaatgacctcggcatggttcattttgaagagagccacaacccttgcgtcggagatgattgatgttactttgagttcctcggcaatctaggactcccactctgctcttagaacaatccgaaaggtgtttatcatttgggagtcctttcctccgaggtactttaaggtgaactttgatggtagcgttcacggcaggtttggaggtgcaggttttgtactctgtggatctgatttcagcttgattgccagcttttcaagcttttagtttcaggtgcggagcttcaagctgcttggactgggattgtgtatgttcgaaggaatctacacgtggattatattgttattaagggtgattatgccacggtggtggtatcatggatgcaaaaaagtatgcaagaagctctctctcattatatcttatgggacatcttcatcctgctagttggatgtggtggtctctctatccgacatgctctccggaaggccaacggtatagttgattaggttgcgacgttcgttgtggaacactccgatgaatttttggagactgatccgaggttgattccttggtctttcaaggatgtttcactttctgcctttttgggatgtattcacacaagatttatatgaatgttttcatttttattaaaaaaaaaaaatctcgggcatcctgtgagcctaaataagttttttattaaattttgaggaactaataaagatgtttaaaattatcctaaaatatggccgaattaacagactaagtcttttattaaattttgatgaacaaataaaagatttagtctcttagttcttgtcttccttatcccatttctttaatatttggactcgtagagtcaccctagaccgtggatgtttgatttccgtatccatatcattaactaatatgaatgtgtggataaacacttcctatccatccaatcgatacgatttttgaggacctccgcaagcaaggttgccaagatgcctcctccgtgtttgaaaagctatcaaatatttccgttggttctttcatttgcaacatccctcgtacttacatcttgaatttgaacttatcatctatttcaacggtgactcgtaaaacgttagtctctggagcccaatctcaaattttggacacacgagaggcaccacacgtcgtactctcggcatatttcaaaacaagtttattacctttctagaacttcttttttttttttcttggtagaaagaactttcttttcaagaaatgcttttctacctcattctttccttctctacgagaaaaacgttcgaaattgaactaggaatctaatgattttttttaaaaaaaattgttagaattttactttacaatttcctacaaaccgagaactttgggagcatagaaaaatcaaaccgaaaatttttcttgatattctttgataaaaccactctgataaatcattgattttattggttttgggaagagtataaatgctaacaaagaaaatttatcattattcataaatcaatttgtagcgatctatcagatcgatcctaataaggaaaacagcaacaatacaattttgcttctttaataatgagttaatcggtgatttccatgcatgcttcacattgtttcgcatatttttttttcccattttataatttatttttgatcatccaattctcttctcagcatcttatccattacccgcgcacttgcattgtttcctacaccggtttcctgtaatggcaagaacgcatagagaaacagagcctcgcacggaaggagacccggagctgtttgtacgtgcattggtagtttagacaaaaaatgtggcaagaattattttcaaatttctctcctttccaattcgtttttttataggagatctcccatgccacgatcattccagccatagcatctctccattccgacgttttatacggaacacctcacaaaaccttttatcagcacaagataggaaattatgcaaggatttctatttgtataacatccaggaagaacctctgtgattctaatcaaactaccacgaataaacatgtattaaaacatctaacttgtcaatcagcatgataacaacaaaacatgggaaggtaacagatctttactcctcatcagtgcccgaaccttcggaactcgagtctccttttgatttggcaacaccattagccaatttgctcttcttatccctcccatcatcttcatcatcactgtactcgctctcgtaatcatcatagtcttcttcctcctcctcttcctcttcttcaataccttcatctgctggcccttcctctgccacatggcccctagttcctgcccggcttctctttagaacttttagctttacgttcgtcttcctatcacaacctatccatgaatcgcacaaacaataggagctcagattatagttcccttctgcaggtgcctgaaacttgcccataatcagccttgatccattcttcaccttctcaacagcttccttcacggcagtacttatttccttcacacctgcacccaaactctccttcgtttcttgaatggccttggatgcagctgcaatggcagcagcttcatctatgaaactgaccttttgggacatccacacatcatttgagatgggatcagcaagcagcaaccagaagttttcctccttgtggaatgggtagtacggggcatgggggagggcacctattagaccattcccacgcctcagtgttacccaagcatacatcgtgacaatgtctccctcttgtataccttcttccccttcagtctcacatgtgatctcaactgtgattgaagggatcatctcaagtacaagctctacatcatgtgcttcagctgcagaaagccctgcagcctgagtcagcagctcagcacggtcctccacagtcatgtcccgtagctcctgaagcgtccgcactttctgtagaagatgcacagaatcaaaaattaaggattcacctgataaatgacagaaaatcacaaataatatggcttgagaaaattgacaaaaaaaatgcccacaattgatgactaaggaaaccgcagaattgtacattcatatacaacaataagactgcttacaacgaaggatgggaaggttttgattgaatcagattacaatttccaggtagatacatatcggtcactaacactgtagatggaaagctatatcgatgaaatttgctgccccaaggatcatacttcatggccggtagtacatggaattgaaggatttgattttgtagtttcaacacacaccatctttgtcatggtgctgattgcctcagatacatgcacccgaaggaatatatatcacataattaacgctcagaaatcaaaagcttcaaaatttaatttggagatcattgaagtcgccagcaatagagaggtcagaataaacattacatttgttaaaggtaaaatataggcaacaatctcatgaaaaaatttgaaaggtctaatatgcatttgcatccatgttggtgtgagtcattaactttataccaattcaatcagaaagggaatcgacatgcctataagctgaaacaaggtaaggttttccaattccacctaactaatgaatacattatatataacttagaagggtaagatgagtccaggaagattaggttattgtgcaggatgctgagatgatggagctaaatgttagataagatgaaagagaagtataaagcagtttctgggaattgttgcagcttcacagatgagtcatccagagaaataagtattaatacatgaatgaaaggtgctgctggggaagctttaggaatcaaattatatgtcttggtggcccttgtaatgcaataaatcctcttgaaatcaaggaacaggccatgttacaaggtctaagtctggtggacgaggaaggattggttagaaacattgtgtcctaaatcagattcatgactgattaatatgttacagaaggggctcatgacagaataggaacctttgttctccctaatgttcttcaaggccagccatgtctaccatgaggggaatcaagcagcagctgtccagcaggtgaagaccaacctagatctcagtcacagcaatcctattccagctaagcttctgttactcattcatgctgatctttttggttgcattttttgttagacactgagcctctggcctcccacaataccaaagaaaaaggaaataaaaataaaaaaataaaaaggtgctaatgacagagaataggcacctcataaagagaataagtggaaggaactgaggaacgcaacaatttcacagtagattatgtcagaggcaaaccagtagattatgtcagaggcaaaccaggtaaagcattttcagttagccaagttatcaggtggaacctgtacttggaatcagggacctgaaatgggtacttactactaagctttctgtctgaatctggaatgtgatatatactgattttaagatgacaaattttcctttccaatgaagaactgaggcacttgttctgaaatctgaaaagaaagaaactctacttttcaagggagttgtttgatgtcatgtgcacatttacctaacagacagagaagttgttaaacattgaatggttaataaaacaattgtggtcatgaatggttaattaaatcttaaccaactctttttcaaattttaaattaataatatatatagcagttagtatataaagctcagttaaattaaattttcagtgaagctgctaatggaaacagggcattgttgatataatctaatctttacacgataccattcagatgagattaataaacttaacctgacttctctaaattaaaagagttcattgcaatgtccattccaagaccgttacatggcatgaactttgtcctaaatatattatgtacaagaacacatcaagatgcataacagtctctatggcaatatgtaggagaaagtctcaaaagcaaatatgataattgattgctatcagtccgttggacaaagccatgccaacacctaaaattaagctcttttgcatcatgcaagactatacacatgcccactgacattagcatttctccattccaggccatcaaattacctataataatcatgaaattatatacttgtcaacattttggatcaatcttacctcttctgggagtgagtatgggagtaaatgtgtactggactggcgaagtcaaactctaaaaagcatttggaacaaggaagtgcctacaaactgcacacagtataggggtggcaactggtagggttctgctaacgtttggccatatccatccgaaagccaaagtacatatgtcagacccaacccctatctataatcctacatccatatccactgttggacataaacttatttgggagatagtaaacgcatgtaagctattatgacaaattatagaactgttttgttaagttaatcaaccaaaaatattaccttctgaacattgcatcatttacatcatgcagtggcatgagtggaatcctagggccaaaggtgaagaaagatgaatttgatagtttgaatttacacaaacagatcactttcttgactcaagctccacatattaggtcaagttcaggtcttagtgacatgtctcaatcctacctgagtgaatcaggcagttagcttggccctgctcaacttcaaatcagctgacatgttttcatgccaagcccaacccaaattaaacagatactgttcaccttggtctaatctacatcttgggtttaggccacgttcagttcaggccaaccaagcctcaagttcagccccacatgaggtcaaccatgtaaaagattaatcttcccaataattgaatgtcaaatgcacatattatggttaactgcattctacaaaaaaagaggagcaaaagatgttatgtactattgattatactttgtttaccttgcgggcaatttttttcacaactgtctcattgaaatgcgggagctgcaaaaattgtgcaatgccctcaggatttcctccagttgtttttctcgcactgagaggtacagcctgtgcattgtaaaaggattagactgttgaacagatcagcataagaatccagcaaagagtagaatcaaacttaaacaaatgaacgggcagaaatgctaggaaaacttgatgaatatagtgcaactattcagtggtcttgcaaatatcaatacatattaacaagggagttacccattgaagttaccaactagcagagaaaaaagtaaaaaaataaaaataaaataaaggaaaataagaaaaaaaacaccaattactagttcaacatgtcaagaattagacaacagagagaagtattggacacgacgaaggatgaggaaacaaatcttaggtttggagaaatcaataagttgaatacacctctcgagaattgaccataatcagatcaagctagtcaagcacatgtaaaattcaaatatgcagttccatcttcaacacttccgaaatattctgcatgcatgatatcatccagaaacgaacttcaaatgtaaaaagttgtaaattcagatgtttaatgatgttgatgcaacaaattattgtttggacatttaataaacaaccagcgagtcttatctccaagggtgaccctttgtggaacacgatttgatcctctagagttggattatattcttctagctcttaactggaagacaaatccagtcttggtattgtaatcctggctcagataactttgtgggaaactaggcttgcagtgaaagctaacaaccaacccttgcaggatgacctaacttattagtcacaatgttgaaatcatgcaacaaatgaccttcttaattgattgaggcttagaaagaatacccaccaaatgaaaagggaaaacgacaaggtttgacattaggaattgcatccatttctaaggcaaaaattatagatcaccaagccaattggaacaaaatacttcccaaaagtacctataattaacaatcagacgtttaaattgaacccaggtaaggagcaagaacttctaatgcacgatcaacatgagcctgtttacatgaaaagatcaccagaaaatttaaatagataaaatattcaaagatcctgattcctgaatggaaaataaattcaagctatggccccttaaagatttcatgatcgaatagttgactaagatcatcttaaaacctgtttacaaccatgaaattgacaaatcaggtacttgctgatgcaaatgttaaaatcatgtagccagaaattaaacaacctccagaaaaaaaaaaaattctaaaatccaaaacatacagtttcaatactttcatcaacttttacagatacactgtaagatacttgctgatgcaaatgttaaaatcatgtagctggaaattaaacaacctccagaaaaaaattctgaaatccaaaacatacagttacaatactttcatcaactttcaaagatatattgcattgcaacttgaaacgaccatagaattttgaaatttgaataggaattcaagaagagtaaggctctggtacaagctcaaataatcaagtcatgtcgccaatatcagcagcaacaaaattgagatccaccaaatgttctatctattttaacttctttgttttgcaaataaattcttcacttgctacagataatatgaatgtacagaccgaactgtagcatccatctgatgataaggcatacaagttaggattgttggaacactacttgtaaaacagtgaagaaagaaatttgaaccaaggtagcttttcttggtggttgctcaagactagtcagcttgctttcaagttcaacaatattgaaaaaccaaggaaaaattcacaaaacattctaatcacaggacagatgatttcttgatcactttgcatcagttaatccacgtagaagaagaggcaaccgaagtcagatgactgccaaagcatgaaggatgttacatgaatacatggtgcgaaaaccaattccaaaatttagtataggaatcagggaagtgttagcatttcttcatgctcattattccatacagcatttttgcggttgtgctactttttgccagatgctttctataagggaatatatgactattgtcaagcatgagaagaggcaatgctaaatgcctgtttccaggaaaaagatttcattatttttttcttttaatgaaaaaggttcacccaaccaggaggaaaatgaagaggaaaagtaatgatgcctccgcaagctaaagagaatagcttttgatgagatccataacaagcagagcataataccatttatctggaacagtgacatctatggaaaacattcagataacggaaaccacaaattggagatcaatgatcctgagatttgtagaaactacaaaaggaactattatacacttgaatgtcaaaatcagtagcatgcagaatacacatctgcaaaattgattaaggttctgtaaaatgagaaattgatattttcaaatcacaagtcaggttaaagaaagaagaagtttgcatgactagtcaaaattataaacatttgaaatcacattgtttcgttcttctttattattggcatgttgttttgtatatacaaaaaaaaaattgataggaaatgcaactaattaagcacctgaataatacactgagaaagctcaaccaccccaattgcaggcctcagccatccatgtccttgagaagtgcgtggtaatacagcgatctgcatgtactaacacacattaggatgcagtacaacatattctttggtaaaaaaaatcctagattacacaagtacaagataaatgtaaaagtagttaaatcaaaagatcagaaagttgtagaatgagcctgatggcagacatgtagatctagcagtacatgttgatcacttaggaaactgccaagcttttctcagacagcaggggcaaaaaataaagcaaagtgttttgactaataagatcaaattaaaatgttaaatggacttgttagagagagagagggagagattagttctccatgcagttcagaaaataatatttttttctatgagaagtgacataatgacataacactgttatcttgctgttattaattattatccattattttgtattatgatggtagaaaatctggtatgacatcgaatattttattcccacaatattcaaactataaggccttattcccacaatattcaaactataaggccagaagtgagctaatataaactaagaggatacattttggagaatctcacaggtaccaatgtttgtgcagatgtcaatatgaccaagctagtagaacaaacaacaaaaattttcttgcagtactaatgcaacttgttctatcatcttcctataaaaagggttggcattaaccacatcaccaatgcactagtgaagagaattccttgatatttccactttcatatctacttatgctttgcatgaagttggcaccatatataatgcaaggaaacctaaccatttagattgtcacaaaagaccagagttattaaaaaaaatcattcgcactcgcatgccctaaaaacttgagacacaacactgagttggacgtgttatacatgtctaagcatctaacacaccagtgaagagaattcttcttgacactaaccctttagttcttatgaagctttttaaaacaaacctattatgctcccatttattcatcattgcaataccaatgctctggagttgtcattgaattgagcaagtaatcttatatatcaagatcaataaatatcaccacagcttaggtctatgagataattatcaacttacttgtgttgcaccttttagcatacatgtcagacatgtcactgtcataaacatgtttgaaatcaaaagtgacattatcctactgctatgcacaatatctatactactatgtgaaggaaaaaggcaccctggtttttgtccatcccattttattttccatgtggttctacacattgaaaaattctacttgtaccctcttattatcatattccgatctttgcttctccagtaagaattaatttcagaacctctttttgttaccattatgtgtgtggggctcacaacgacagaaaatcccaaagagcacttatttttaatctctctcgcacagcctccccccaacttactctctctctctctctcacagacacagatctggttcaaagataaaatcccaaagagcttatatttttcattactctctctcccttagttactcattctctcttaggcacagatctggttcaaatattttggctttcagctgtacaattttcatatataaaatctttttttttataaactataaaaatgtaaacgtttcttgcttcattattctcaattaaatggtgtggtggatgcttttcaatatacagattatgtctaactcttagttttctctccacagaattagattgttttccttgtattacaaatatttcactccattttgtgaactcttaactaagaaacctccaacttgtgggaccttgtcatggtaaagtaaaagtgctgttaagactaagaagataggatttcagaattaaaatgttaggctctattaaccctctgatagctttacatacaaccttatataaattgagctgcatgcttaggcctttaaataggctccactactaagcctataaacacagcattaaattctcttgcagtttttgttgaaagagaagaggtccattttcaaatcatgggccattcatgtcttgcaacaggtgatagcacctgatgcaacatttatagtcttggctttgtccaatcacctattatcaaatgaaacttaatatggactagaccacttcagtgagtgcacagcaaaattcttgagtctcatcaaatgccggtttaggaactttatgcatgaaaaatgattgccccatagcattcttcactaggtaattagtgattctgacaccatgcccctttttttcactcagatttggcaggtgacttaatgtgaagtctcttgagagctaggaaaaatgatgataacattcatactgtttagcatttgatgctttattaagttgttaaaagtttcttaataaaactgtagtaagccatcttcgaatttcagataagaagagtaggagtgcaatcacggaatgaaatataagatgttagtatgttatctttgaaataagagtaggagaagagagagtatgataggttctaccattccttttctcgatatctagaactcttatcggtgttcattatttctttggtcgggcatctgagctaatgacaacaatggacagcaaggttcgtcgtaccggtaccggatgccgtatcgatgaaattctgtttaatgtcggtacgcggtttggtacggtatggtaatgtcagtacgcttcggtatggcgtaccgatacgagatcggtacggtatgctacgggcggtatgggacggtatagtattccatgatggacagtaatgaaaagggaaggacaatacctacattcattctcttctttttttttctttttcataagaagaactattttttagttttaatttgtttatttaagtcataaattgcacatatttggtgtcttcgttcctttagaatgctccgtgacttagacactcatgtacgattttaaaattttaattttaatttctgcatgccaaaaaccaactgtctttgctcatcaaagatagataatgttggactttgtgtggcgttagagatagggaacggaatgaaggcttcaattttcctatatcaatgggtttgattagtcaacttgccatatcttcatgaattaagggattagaacagttagtcaaaaaaacttatttgcattagttttaaattttttttaaaaaaaaaaaatttcacatgagtattccaattaccatttgtgcactaaattcttggaagaatattttctttttaacttgcaatacatcaatatgatggatttatggtgatttaggtcattaggtgtgccgatgattcataaatagcttgatttaattgcacttaacttttttatcaacttccaccaattcaataactaaagaagggttcaatatccttcattaggataaaattaaggtcctaaaaatgctatacatcattgattattttatactggtatgcagatatgcatttttgggccatattgtcaaagacaataaaaattcaggattcaaacaattatcaatatattagacctaggatcacatgatctatggagcaacaaactcattggtcaagacttgagaagaatatacttatcaagtgcatactcatcaagagttgacaaccggatctgtcctgcatgtatggttgcttgcaatttttgaatctcattaattgttactacttattagtaatctattcttaattgagataaattctcatacattgaaagataagtatatcatagttattatcctaatagaaattcttatacattgaaagataaagatatcataattatatcctaataggacgtttaataagtggagttctaaaagattcttgtatgtaatatctcaatcatgaccatgttgaggttttggctaggaaagagtactgaatgattctcgctatatgcatcaatgtttgtgaggcttaaagtatgcaacatcattaacctagtgtacaaacatggttaataatatttacgtctcttgttgcttaattttttttcaatgactttaacatcttacaactattttcaataattcaagtttatctggcaaataacctatttagctcaaggaacttttcgaagattatccgaatactgttcaaaagtttagataacgcaaaatatatgtaagagagaatatactatttaatgtatgactcaattacaagtcattaaaacttagataaatttattgcaatggaaaaatttcacaaacaacctggagaaatgtttgcaccaatatcctaatttgtgataatatgtacctgcttaaaaccattgcattcctaacagaataaaggggtagtagttaaagtatttcatgaagtggttcattgcatataatggccaccttttgaatgttatccacacctggtcgcatgcattacatgtgcttaaattaaaactaattatttagcacctaccaacaagagaagcatcttccaattatatagaacaataagagatgaaacattctaatcaaattatctgtagtattttctgttctaaactatgagaaagtatcatataattttggttgaacggaagtccccagcacccgcaaccacttgcctctctacatgtgatttggctcacaggttagtgttcgagcaacaaatgtagtaaaaagagtccagtttatttgatgtctaatttataggacaaagtctagtttctagagaagttttcagttcagtatacttcaaataccttatggtatggtatgatatgcaccctgtaccgagacagcttttaaccatttttctcactttttatctcattatgttttggtatggttcgatatgccttagtatgagtcgatacccatccgatacatcttggtacacctcagtataaagcctgcaccggcacaaacctgatttcataccagttcccacttggtatggtacagggcggtatgacagtccataattggaagcctaatctgagctagaaacaggtgttagaaaggcagctctaaatatcttttcttttaggatttgacgtgcaatatcaggactgctatgagtttactaatgaagttaaatattgcataagtaatgtatgaatgatattggaattttaagataaatatttttggcgggttacacatttatttgcctgcctcttcttctgcttgaacttatatcttacttttcttcacttgtctatcatattacttcatatctatgggtccatccataactaaagatataacagacaagagctacaagcttacaacaattacatgcacccttctttcatatattctacaactgcaactagctatcactatataagaagtgcagaaggctgtgctgtatcacgattcaaccgaaattccataaaaggaaataatctgaagaaaatttatccacaaactttccaccaagttgtggtcaaagattagacaagttaataatcctccaaagaattgctgtggctatgaaagaaactggaaggttagttagtcctaaaaattcagaacatagaaaaccataatatcagtcaacgactttgttcagatgatgaactgcacattataatcacaacctttatatctacattgaacagaagaagctggtaactttaaccatggaagaatatatacacataagaagtaaggagttaaagaaagaattcataatcaccttcactagttcttcaagaagacggggtgcaagttctagcatacgtctaaaatcactttgtagagccgaagataaagaagctgattcacgggttaattgggcttgaatcagcaattccatctgaaatcaacaaaaaaggactacagaatttgaaggataacatcaagtacaaaataaagacaagaattatcattattcttggtgaggccaatgatccaaggagatgtaagtgtttgatttctatgtcttactccttttgaactgcgtaggatgggctcattggcaaccacctgaattctgaagtataaatagttgttggaatgctatgcccttatgggctgtgaatgaagctaatgtgatcatagcgtgagggctgaagaatggtccgacagttgtatgccattacagcatcttcagcacacaataagatgaattgctgaatatagatacataatactaccttaactaatgacggatgctgcttccaaaactttgcttgctctgttttgatgttttttaggtccagattcaattcacttctaactgccacaaacagtttctgaaggggttcatcatcacttctacgaactggtatttccataaattctgcagccttgatgaagacatccacaatcttgctgtatcattatttatttcatcagatacagaaggaaaaaattagaaaacagcttctagaattaataagggatgatgttatgtggagatgttaatatccagaaaataactggatgctctcaagttacaatgtatctgtgcgccagctttagctaagtaatctgcgagtccctcatcacaacacctttccataaacaggcattatcaatgtcttattatatcaattctttggtggaattataactaccgaaaatgaacaggtggatggcccttgttcttaaagaaagcagtttcttggatcttattgtaagaaaaccaaatcacacagagagatgagataaaagcagtgttgccaacaagcctcaccaagacgagtatattttagataagaaaccaactttttgccaacaagacaaacctaagatgacattaaattggggttgaaaatcctaagtagcatgttcacaggtcatcctttgctagctaccttctaaggcattagcatcatttgcagaagctgaagtgcaaaatggtgataagtctaacaatcaccaatctctgcaacaaattcctgtaagaagagatctcatgctttattgatcaactacattatttccatcactatttttttttaaaaaattatcttaccagtcaaagagctggatgatcatctcaccagggttataaaaacaaacattagtcattttctctttcacatgttttctgctatttcacctaaaaaaaaaatctctcatttgagaatgtgttacaaagcacacacagtaggtctggacactgatgtattatctagatgttccaaattttgagtttgccaaggttatagatacctgaaatagaagtgacaatggattgggtattgggttgggtaaaatttggtttgggtcaagaaattcttaacccatatctgacccatttataattggagtggaaagaataacccatgcccaacccatttattttatatgagtatggaccccatagccaacctgccaatccaattagtgccttactagtcaattataaagctaaaatttgagggtctagtatggagaatacaaataaagtgagaaaccgaggagaaactgaaatgatgaaagggtaataaatcctcaatatgctacccctttaacatatcttcattatattttattcatttcctgatgatcaatttttcagcatttccccggctttgcattctgtgtggaagaagtgatgagattacatatcacttgtccttgagcgatgttacctcttgaatatttgagtattttgtatataaacttaacgttgaagatctgccaaaatcggtgggtaaaatatggaaggagtggagacagcacaatgttagaaccaattcccaatctagggtggatgcattgcctcagtactttgctggagtatttggattgaaagaaatgaaaaaaatattcagaaatcaagctacaacaatggagaaggttaggaagagttctgttttgtcttgttttcaattggacggctgctaccgctaagaggagtcaagcactacttaaacctgttctagatatctttaagtcggatctgtaacctttcactcggtctaatgtctcttttctactccataataaattggatcagggtctgcccaattctctctcaaaataattgcgtagccttcctaaccaaccaaatcaggccttgagtaggccatagcccatcacacaatttcgactactataaaggttcaagaatggattttaagagtttgcttcacccattgtgacccattaggttagacagtcaaatccataccccacccacttataattggttgatcttggctacccaagcccaatcaaattataaagaacctcacccaagcctatttattttgggtagttttgagtagatttgaccaggctggcaggtctacgttagaaactttgaaccctactatggcacacgcaacaactcatgacactcctaacactccagaccatcaaatcatgtacccattatcaatgtttacatttggcacttgtactgacagacattatagttatcaagtataacatatcctttagaatgtagtcaatttatgaacttaagaagtaggcccagctccctatgaatttatatacatcttttcttcaggagatcatataaccatctatcatgattagacattcatataaaagatatatgtgtttggctaaaaagcataattttttggaaatagaaagttggaacattaagtttctgaaatagggtgaccaaatgcatgagactcccaccgttgtggggtctgaggaaggtcaaagcatgcaagtttgggcccagcgcggaggggctatttttgtgtttcgaacctgtgagctccaggtcacaaaggagcaaccttaacgttgcaccaaggcaagtttatgaaaaatccatggagaaaatattgagaaatacatggcaatcttttatggaaatatgtactggttggttcctcatggtttcctgaatattctggatgtttccaataagttttgctgttccaggagcccaactgaaatggggttcctatccaggtttcacaagagatgttgatgaagagaggaaataagaatccttgtactgctacaggaaacaatgaacttgaagccaaaaagaggctgagaatatggtagctaaaaaagctttgatatcagtagtagttcccatgcaactcttaacaacaatgatcatcttcaatatgcaaatttcaaattgaaatagatttatttttgccagttcacataacatcttatgagacccattaacctgcctgagaaataattccagaccatgcataataaacagtaaaaagttcaagaacaactataatgaattaacactaaatataagtatgatttttatgcacaataacatgtaatccttattataatagcctataagaaaaaagttttagtttttggttcatatctttgtgagttctaaatattgaatcaagattcgcggactcggtattggaactcgtgccggccggccggcggtatgggtcagtacaaattcgtactagaccggatcggcgcgaaccgacataaagcaaaagaatcgaatcagaaggaaaaaagagaaagagagagatagatggggagggggagaaagaaaaggggggggagaaagaaaaggaggggaagccgtcggagaggctactatggccgcagaacggcgcacttgatacctgtggtgctgcaagcatgaaacaagggcgctcgctcctgtttcacggatttttttttaaaaatgcggattacggtgaaactagcaaacctattgctgacttcatagtttttaatttaaaaaaaaaaatcttaaaaagtgaggcctggcttcaccattcatcgatcgttttaaaaaaagccgatgagtgaacaaggatggtcgcccctattccatgctccatccgcatgttttccgctgcccggtgggcggtggccacggcagcgacccgacgcccttcgatagctcctccaccgttcgctcctccctccaatacgatcgctctccctctctctctctttctcgctcatttaaaagccctattgggcgatatcgagccacggaggcttccgcggccctctgatggccacagcaggccaccgtcggcctccgacggcgtcgtgatttctctctctcctcctctttctcttcctctcctttcctctccctcctccgatgaaccatttttctcagccgaaccattctatttccccatcggttcgactcggtacagggtgtaccagttggttcgggctagtacgaaattttatgtattgaatgattatattagattgccattctttttgacctcctacaacacaaccatttcaaaattatactttttacctggagctagcagtttgattcatttggatgatttttgaacccttcctccaagaagcccttacttgtctcaatcaagttttggtacattctttcgcctaccaccaccaccaccaccaatgaaccgctagagacacaccaattcggttcaattctatacacacctcttttatataaaattacaatatccttcttaggtttttcctcaaaatgatcctttctgaggctttaactatggtttttcaggattacaatctgttaggtacccttttttttttgttcttttaatgatacttgctaattgtcatacttcatttttggttcctgttttagttgacaaagccttcgtatgattcatcacaaccaagacctcctttgcctccttgggtttgacactccatttccatatttttggcccatcaagtgctcaatatttgcctccttgggttttggtgcttccataagaatgggcaacttcttgcttcctactccacataagaacagcttgggacttatggcttagcatgcaatgtcattttttttttgcaatattaaatttcaatatgatctagttacttagggcccattaagttttttgtacgttcattttagcctttgtagttcttgcaatcccctatgaaatagtgagatccacatgttgttgctagcctcacaattttgtcatcatatctttcctcgagtctggcctgtccatcttcctttatggtagatgccattcttgttgcacatgtttaacacataaagcatgcctacaatttgttggttgtctcaagtcaattgtctcactaatgtttcacagcataaaatgtggtttacctctccagacctagtatgcaagtactaatggacccccacctgctggcagcaaccaattcatgacaatttataggagcaattgatcctacttcactgtctaggatgtgcatattgctgatagctgtgtccagtaaggtgaactgcttcctgcaagataatccaattgtcctcccaccttcttcaagtatcatctcagtcacaccttactgagtcatccacaacgttgtcggcataaagtacaaaaagctctaccattctcatcctctcattagcagatgcattgcacaagccatatactataatttagtctctttaaaggcagactcttggcaatgaacaaccttgagtctgagtgcagagctagcacatgccaagtagtgtgagagataattatagtagcatatggtaatgtatacacgtagtttgtttattgtgccttttgtaatttcattctaaaatatgagtttgcacatgaattgataacaatattaatgtttatacaggtctattgcacttaatatgtgacttatgctcctgctaatagggagtgtgtcatttgctaaggtatatatgctggtaaattccccaatgagatttccagatgttttaacacttgacattcaaatgctttaagaatggcgatgcccactcagcaacagttcgtcaccatcacttaagaacacagctgacaaacttatgcaactatcattattggcaacttataataattaaattcagacagagtacaatacagatgaaatcattaaatatattagggaaaacatcaggtggtgctacataccttggagctaaagaaggtttcatgaaatagtagtatgcggacaaagtttgatgcatgacataatttccagtatattttgatgatcttgagaggtatataactgctatcaacaaaggcaaaagtatgcaaattccaacaatcccaagcaaaagtactccaccagatgctccatcaaaattcagtaagaactgaggtaaagcaattcccatttgaaatccctaaacaaagtaatataaatgatgtaccttagctcaaaagcaaatgctgaaaataatacaaaatttatagaaaattaagccttcaatcagatagatacaaacttgtgaacaaggaaactcacacaaggggaagttttacctgtctgccatcagggtggccatatttttcaaaattttcacgagaaataggatctgtcagagcctgatatgccttggatataaactccacaaagtacttatgggcctctggaacatcagcatgtgatcaaagtcggaataaggagaagcatccataattaaataatgatataaagatggtctaacatatggaagatcttcaacctggatcaggatttttatctggatggtacagaattgagagtcttcgatatgccttctttatttctgaatctgaagctcccggctctaatccaagaatgctaaatggctcaaatggttgagtctgaagaacagcagccaagccaagcataaataatcaaagcaaaatcatattggcatgaagataccacttatagtggttaagatgccttgagtgatttatcaacaatttgttaacataagttagcactgccttcatgttgttattttggatctatcacataaagaatagagggacaaaccaagatatatctactatcatataaagataattctccagatatctgcttcagtagactttcaatgttttcaacttttaaaggaatttttgtgaatatgtattatttttggatgcaaccaccttggtttagctcttttttttctttccttgattaagagaggaataagataactttgacaaccaaaagtcaagatgcattaatcatctaacatgaattgagatcacaacggtccatgtccaatacatatacaacaaaaggtttgacaaaggcatgtttcactaaattaaggagagttcattaaggttcctttgaagtgttagtaatcccagaatgcccttgagagcatagaaaatgtaatagatattctctaaaaatagatataataaagtggatatggggttaaaccaagattggaaattggtatatcagaataagtcccaaagttaacagatattacaaatggtaaaatggaaaaccaaatgaaacttttgaacagaagaaactatggtccaaggaaggttatgccaaggcctggtaggttgcgttaaaggaccatgaataaaaacagcaagacacaagagaacaagacacaaattttgagcaacgatgtgaaaaaaggttgaactggtggggctaaatttatgcaaagaaaaggttaaatacttatgaagattgattgctattaaaaaatctagtagtagttgttcgagaaacaagcaccacctgaggtattgaggtgacaaaaagtagatagctaaacacctacagcatcatgaataatacaaaaacacaagccacgcctcctagagaaggccatactcaattcccagaaacaccaaaaaataaacaaaaggaaaaaaaaacaagcaaaagctcagcaatggtccctggagtgggaagcaccagaaggcatacagaaaaggcagtggatggaaaaaggtgaggtggagtggtagtttggggagcaggagtgaggtgagggatggtgctgctagaggtggtctgctgagcagggctccagtttgacttggggcctggggctaccattgataattgtgacaaagatcccatgttgatgcaagtccattgctggagctgggatgcagctgtacaatgtccctacatagggacaagctgaaacccagtaccatgcaggttggtacagaaaaccttgtttttaacaactatgcaatccaataaatagtcaagtccataaaagttacggtacttgcaatacctcacggcttatatgtttaatgtaataaacaagaatccccatgatgacccagagcagcagaagtgtcaggttgctgcaagttgaaaagtttgagatctgcaaataaatcaaaagatatacattatgctaaaccaaatgtgacaacttccaggtataaactagaaggaaccatatatttaatatttacccgtttgaaaattgatttatgatacttccctgaatgtgaacatacagagcactggcaatgaatggtctttgtttttttagagacagcacggaataacctcagaattgtgtaaggcactagaggcagtgccattattgttaagatgaagattggaaacagagagctgttgtcctctgatgcagccattgatgccttatgatgttggcaagataaaacaactactatgatctgcaaaagggagtcaagatacataataaagagatgactgcaacttggcattaaaaatgaagaatgtatatctaacagaacagataaaataatcatggttgcaatcacaattatggaataattagctacaggaaaaaaaatgtctcttgcttgttataatttattgcgaaaaggacatgaccaggtataggataaaactaatacacaagaaaaacacctagaaaaataacaagccacccaccctcactagtagttggaatgtaacacataaaacattagatcgtgcacaacaaatcgatcaactcttctaacagaaatcctgttcctttgaccttcccctagagtatgtttatttctccttccaaaactccaatgacacttgcgtaagggaaacaaatctaacagcttcctttctctattagcaggtgaaaggcaacaagaacaattcaatttttacctggataagaaaccctgatatccttccatatccatatatatgccttacatcagtgtaatgagagaaaacaacttcatcatgcacagcacaacaggaacgttttacaagcaacttccactgttggttttaaagctggttgtatctatggactttcaccaagatcatcaatcaagagaaaattaggatttacaagggttcttcacttccaaactagattcttcagtccgcattagcgactgccactagtcaggaaatgaaactaatgatgcatccccaaaaatccaagctattctttttattttctatgaaaaataaataaagaattatcacctgtcactttcttgccttttctcatgcctaaatatcatgtcatgaatatgaatataaatatgtctagatatgtacgcatttacatcagtatgtattctgttaacctgaaagtctaaacaaagttagtccaaattgaaagaaaatgtttaaattcaatattaaaacaatacctataaagtccttgaaaagaggtcccaaacaatacaaaaacatctactagctgccactgcctaaaatcattgaagtatcaagaatttcatgatcataacacaagttgaggaatcttcaataacaggttgtttaacattaacatgggatgaagttcaattcataaacgttctcatgattaaatatccaaaatttgaaaagacggatcccataattaagtggtccaacaagatactctcaccaaggtcatgtccacactgagaaacatgaaggattcatgtcaagatcaagttccccataatgatgcaaccaatcagttagaagagacatcatcatattctatgtcaagactcaatattatgaccataatcaaccagaagagacaacatgagacctttatcctaatgtttagcttttagatgatacagaatgaaatatttctgatgatacaatattttcaaatagttcattcaccaattatctgaccctaagtttaaatgttttccactatccttctgaggtaaaccaaaaagctgaagattgggcaacatatgtggccacatgatgctaattaagacaagtatggcagcacagtgcttagtggactgcctttttgaagcataagagatatggctgcatatactaagcgcatataggcaatttggtatggtcaagtgaccacatatgcataagcagccacatatgcagcctcatgcaccgtatgataaatcattggcagtaattaaacaacacatcgatgtcttggctaaaagcagtctcatggcttttggaccttgatcagggtaattgatccaaaagttaaggctgttatcagggctggatgaccgagtcctttttccttggaaagaacaatattctacataagtcttttcatcaagattaataacgtactttgggtattttagtttaagttgcatgtctgaattttccaaacaattttactaggaacttgtgcgaagcccaagataatcaattgtatagggcgaaactaaaaactgatggattgatctggataaaataagtgattagaacagacctgaataatttatatacagtaattgaccatggtttcccttggctctactctataattatctttacagggaaaagctcctttcaactagagaaaagatctggttattcattgtacatttttcttttttttgttccagattttgtctttaagtcatatattcaacattctactgatcaaagcatctacagctggatcaacctgatatactcttcataagctgtgaactaaagtttctcatatttgaagagaaaggtgcaaatagagtagaagaccaggttgtgccagattggttataagaggttgacaatcttgaccatgatagtataagttgaggcacctaaaacaacatgatgatgaatatcgatcatgatcagaagctttacgtctggcaagagatgttagaaattaattaaaatgaaatattcaaagtgcaaggagacacaatccaacaatgggatgatttaataggagggaaaaacaacatcatatccagagaaagaagaaggattcgtgataagatcatccagtgaaccatctagaagggacagcatgacatttgaccctaacagtggtcttagctaatctagaaacaaaacatgtcttagctgatctacaaacaaaaatttctaatgactcaaataaacatgcaaaaagaggctaggaatcaaagagaagaaatcagccatgatgcattgcagcacaaacaccactcaaagattgctggatgatataacaggttggctaagagatcaagtccctaaagaaagaaaataaaggatgttcaaattccacaaatagatcaagtagattaggttgaagagcaaagggtaattttgatcctagtgattgttaaaagagaagatattttcaaggatccaaaaatctgaactccaagaatctaacaaagcatcccagatgataagatctcgcaaatctctacataatatgcagatatgaatggtgttgatctatgtttcttcgtccaagatggctagcttggtggattttgaacatcccaactcaatgtcctttagctagtgcagcgtccagcatcccttgctcttcctccaccattatgtttaggaaattttgtaaggcacactgattagaatctagcaccatacaaggataagcaaagaaaatcaaagaagaaaaatgcatcttgaccaaaccagatacacttccctcgataaaaaggaaaaaaaccagacacagctgtacacaactaaatatacaaacatattagcagagaaactatctagccacaagagaaggaagaattaaaggaaatatccttagccaactgtcagtttccttattcaataaagtttatacaatatcatcatctagccttaaacaattaattaggttattagccaaccaaaagaaaagcaatgcaatgtgtattgagggttcagggagttgaaagaagacccaaaaagacatatgaaaagccctattcttggacgcaccatcattcttcaaatgcacaagataagaatctcacatgaaccattataacaattgagaaaatgatcactgcattctaggtttgatggggaagtggccgaacggagttgcatttttttaaccttaatgattctttaataaggggacacaaagcctaccagcaacgagaatcgtagcacttggtacacacacataaacctgcaatttattgaatttcttcaagaacagcccactctttccaaccacaagttaaaatttatgttcggctggttgtgcatgatcactattgagggaccacgaacaagcaagacgtgtataagaattaggacgaataaaaataataacagtcatctaggtcagtcaatcaattttttttaaaaaaaatagcggacactttgcgatgcaatcaatctagtgataatcagcggaacataaatgttttggaaccataacataaaaaggtagtggagacggacaattgaatcgtgatcaaagaatcccgtagatcaagcccacaacctacagatgagactattagatccaaagaacaaaattcattgtcaacatccataaaagatccagatcaaaattcaatttaggacgcgcctaacattttaacctcgatctgaataattctgatccgaattaaaattcgatcctggaaactaccactcatcctatttcgaccgcctcaaaaagcgaaggaaaatggaaggacacaagggaacgcgtctttacctggcagccaagagagaacggcagccgagccgacggcagggagagaagaggcgggatggagctggtgaggcagcggagtctccgccgcggtggtgcggcagtggccggttgggagacccgaagctggaacagtagaaacacagagagagaagcggtggggaagggtggaggcgcgggatataaaagcagctttgggggaccagagctgcaattttgggaccggagtaggccgtgacggaattcggtagcgacaaactctatggggcgccaagcccgtcgccacagaagatcctcgtgcgcacaggtgatgacgtggcacttctctactcgccagtgcgccacatctggccaatcatttcgtgcaacgtcgcgtgatgacttttgcgtgccagcgctacagcattactcggtcagtggactggtaaagaacgtccaagtattagatgcaccaggtccggtggaccagtccaatagccactctccctatcatctcttgtgtttaaataatttagatatttaattaccgatctcttggttggcgccataacaataaaaactctccattgatcaaaattaaaactctcaaataaaaaaaaaaaaagaaggaagactcccaacagatgctgcacccgaaccccatcttctcctttctggcccatcctcctttctccgacgaccgcccgtgatggcctcccctcaccgacccatgatgcgacggcctccctccccttcccaacaatcgaaatcctttttttccctcccctccccgtcgacgatcgccctccctcccctccatggcgaccgcccgccagcaacgaactccctcgtcggcccgcgacacgatgcccccctctccccagcgcttgaaacccctcttcacctccccagtgaccacttaggatagtctcccctcgtcggcccacccatgacggcctaccctcgttgtgctccccattgacatcggtgttggccttcattggtccacagagaggaccatgagctgcgagaaataggtcgaaatgccctttggtccacgcctcgctcgatggactgcacgcaattttattttaaataataaaaaataaaatacataaaaaataaaaataatataataaaaaataataaaaaatataaatatataaaaaataaaaataataaaaataataaaaaatatttttgataataaaaataaaatatataaaaataaaaaatataatataaaataatataatataaaaataaaaataataaaaaaatttatcaattttgcaattgattttgaaaattaaaatattataaaaaaattatgactgattttgagatcaattttttaattaaaaactttaaaaataattagctaccaattttgtgatcgattttattaataaaaaaatatttttacaaaattagtgattgatattacgatctataaattaattaaaaaaattaaaagtacttatcgatcaattttgtgatcaattttattaataaaatttttttaaaataattagcgactatttttgcgatcgatttattaaaaaaatattttaataaatttaataattaattttatgattaattttataatcaatttttataaaataaaatattataaaatttaaattattcttcgtggatacttgttcatcaaatggaacggtcgttaaactaacataatacatagttaattaactatgatatatagtttaatttgaaggaaagaaaaattgtttctcttcggatagctcaagttgcatttaaaaatttttctattaatctacatgaataaggatcaaatccttatctaattaacagcggaatcagagattagatcttcaaaaatctgaaacagtcctttgcagagacctggatgtgcagatcctctactttgtatacatgccagacgctataagaaaacaggataaacttcgatcttcgcaacccaatcaaacgagggagaagatatactggtgtgacaccttacaccagcaagtgggacgcccaaggagggcccatgccaagggaggaggggcggcaccaaaggagagaggttcaggagaagaaggaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatccataggtagagaccctctctatttatagatgaatcccatgatccaataaatataggactcctaactcaaatatgctttgaatcagtccaatactcataaaagaaggactcctacatgagatagtattaccatcacatatgacaaccaaattgcatccaatccctcacctacatgggacgtccacaataaggaagcttccaggtgttggtcggcccataagagaggggaatcttaatgcaagaaggatttctcatatatcatccaaaatgggtccgattcgaattcaattcgaagctggttcgaaacaatttcgaaaggctgtcaattttaaactctttaggacttttgtaccaaatctaacttagatttttggatccaattaagtctaattaatttaaatataatctaaaattaattagtacttaaatccaatatttcatatactccatagatcatatatcgaaaactgttcatctccgtgatcgaacttgaacctcatgtgtagtgctagctagacatagtcaactcttcaatcccattcgatccataacttaattctcaatcaagttagcttatatgttcaatcaaatcaagtacttctaaattagacacataaatataagctaattctttcctatggtgtttgacttgtgtgtgtgactccataggtttaaatactaagccagcagcacaggaaccgacttctgtactaatcgagataccatctagcaatggttcccgacgtccaaataggtcaaattatcataaaaaaatatttcaaaatctatacacatggttaccgtataattcattcttttgaccctgaatgctctaggatggtttcagattaactgtcaatcgagattacttcatctacattgtatttcaacctttcaaatccatctcatagattatcctgattaaggttttactaaattgaaatacagcgatacatcaactccaataatctgaagggatcaatcccattttgatctacatatagacttcacaagtacttaactatacccagtacccttccgtcactacattagaaatccagatagtctggcatcaaagcacagaattatttgcaagtcactatgatgatcttagaactgaaagatacttatacccatgtgcttcatgagtagttcttgacagcagaatgcttagcaggtgagtcacttgttcagtaacgatgtactcctatatcacacctgtatgttatatcagtgtcaccacagtccttgattaaggagataaccaacccatatagcacacaatgacttccactcgataaatgttagcattctataatgacgtatcatttggtcgcaaacatgtttaagaactatacgataaattctctctttatcatacactaatatagttctaaggacttcatcacaatacaagagttcaaggaagatataactttgtgatgaaaaaatgtcagaataatttttattcatttatcaataatttatatacaaagaagaactcaatcgtcacacgattgattttaggatacaattcccaataactccaacttggactaaagtcaatcggggcagtatcttatacccatcttccatttgaagtcatcgaacgctttgatcccgagagctttagtaaaggggtcggctaggttctcctttctattgattttctgaagctcgacgtcacctcggttcatgatctctcgcaccaagtaatagcgatgtagaatattttgcaatatctgatgcagcattgtattctgttttgcatacagaatcgatcacagtatgttgcttgaaattcttctgacaaatagctcctccattaagataaatacatagcttgacacgcttctgctgtcatcataatctgactgaaaactgaaatcaatatatcccataagtttcaggttaatatctctatagataagccattagtctttagtatttctcagatacttaagaattattttcgcaatcttctaatgcttctctcctggatcagactggtacctactcactatccctactgaataggccacatccggcctcatacatatcatgatgtatatgatagatcccactatcaaagtatatggtattgtactcatatgcgctctctcctcaggagttgccggacaatcttttttgaaaagagtaattccatagtctatcggaagatagcctttcttgaaattatccatgttgaaccacttcaacaacgtattgatgtacatggattaggataatccaagcaatcttctaaatttatccctatagatcttcattcctaggatgtaggatgcttctcccaagttcttcatgaaaaactatgatgataactatagctttacactctacaaagtcgggatgtcattttctagtaacagtatatcatccacatatagtacaagaaagatgactacagaatcggaagcccacttgtagacgcaaagctcttctctattcctaatgaagccatatgttttgatcaccttttcaaaatgcatgttccaacttctagacgcctgtttaagtccataaatagacctatttagcttgtacattttcgactcatctatggatgtgaacccttcagattgtatcatatacacctcttcttccagctctccatttaggaaagcggttttgacatccatttgtcagatctcataatctaagtgtgcagcgatagcaaacaaaattcgaatggacttgagcattgccacaggagagaatatatcgtcatagtcaataccataatgttgatggtaaaccttagtaattagacgagctttataggtctctatcttttcgtccgctcctctttttctcttgaaaatttatttacatcctatgaattttatcccttcagatggatcaattagtgtccatacactatggatctccatagactccatctcggactttatggcctcaagccatttctgagagtcgggcccctatataggtgatcggatcttcatcatttttgtcaaatttaatggaatcatcattctggaccaaaaaaatcatagtatctatccagctgatgcggtactctaccggatctccttaatagcacctctattggctccagatttgattcatcaatcaaattcaattctgtgtgtgtcagttcttccacctcatgaacttcatcaaattcaattttacaggcattagctctttcactaaagaactctttttccaaaaagactgtccaactgcaaacaccttttgttctgtagtgaggcagaagtagtactctttagttttctttggtactctatgaataagcatctatcagacttcgatccaagcttatctgtcttgaaatgcttaatataagctagacacccccaaactctaaggtgtgagagcaccggcttacgccaagtccatatctcatatagagttttatcgatagacttgctcggcactttattcaaaatataacaggcagtttcaagagcatatctctaaaagaagattgacagactcgcaaagcccatcatggatcagatcatatctaacaagatttgatttttccttttagatatcgcattatgttgtggtgctccaagaggggtccactgtgagagaatcctattttcttctagatatgtcagaaattcactagtgagatattcacctcctcggtctgaccgaagggtcttaataccctttccaatctatttctctacttcagcatgaaatcatttgaatatttcaaataattttgatttatgcttcataagatagacatactcatacctcgataggtcatctgtaaatataatgaagtagtagtatcctcctctggcacttatgttcatagatccgcatacatcagtatgtattagatctaggatatcgctggctctttcaccttttctcttaaaagatgacttagtcatcttaccaagtagacgagattcgtaggttggtaatgattcacaatcatctatctcaaggatatgtttcttgatcaacctgtcaatcctattcttgctcacatgatcaagtctacaatgccaaaggtaggattcgctgacattatctaatttaggatatttgttggctgtacattatactaacaggtcgtgatattatgtatatgccatattttaattatccacacataattgcagtattattcataatgatatcataaaaatcatcctttattataaacttgtaactaagtttggccaaaaggcctacagagatgatattcataaaaaaagaaggacaatagtgataattatctaacatgacactactggattagaagacaagctgtaaagttttcaagactagaactgaaacaaagcttccatctccaacattaaggaaccgctcgtcctctcgaaacttcttacttatctgtagtccctgcaatgaattgcatatattaataggacttccggtattcaatacccagatagtagtatcacaaatagagaaattacaaggtgttatcatataagtaccttgtgaagcaatagcttgcttctttatcttattcttaggtctgtttgggtcaagagtggatatataagcaggacaattttttttcaatgatccagcttcttacagaagaagcactctatcttttttctatcaatttttgatgatttactctgcttaggatcggtggcatgggatttctgtatctttttctttttttctctcctaaaggatcgatgtcctgtagataatcctctcactaaattcactaactccttctggagctggtgattcttctcaaaagtctacagtaatcctagtaaaccatagtagttcaccacaggcttcgtcattctataatgattaaaaaatggtaggtagaatttcggtagtaaattaaggatagcatcatcgcctaattgttcatgcaatggacagtcaaatttgttaagatattcaatctgctcaattatgtacagtacatgattggtgactaaagcctcttcttgcatacggacattgaacactacacagaagattttatgtctctccgcatcctttgagatgctgaaggactcattcaatatttgaatgatctcctctacctgcgcatctttgaacttacgactaagtttgtcattcatagctgccctcatcacacaacgtatagccgtacggtcattaagccacttcatgtaagtatctctcacggcacgaggagcattgactgtaggtttttcaggtacttcatctataaggatatatacaattctctcatgcttcaagacgatcttcaactttcgataccaactatcgaagttggatccagtgagtttatcgctgtccaacagcgtgcggagggatagtgtgttggccataactaaaaaaaaaatataagcctattagtatatgaattatttttaatcctgaagatatagactttagtctaaaggtcctcccactatttttatgaattgatagcctctacctccaattcgaaaattacattaattctttagtgggtactagaatccacacagactgcattcggatctgactgtggctcgaccaaccctagtatatccatgggtaggttcataatcaattattttttcaaataatttctagcaattaggttttaccccaggcttcccttcagcaggcgtgtggcacctccattaaacatcctggttaggtctaactattaacatgataacatcaagtgtatctaacaaatggatattcaaattcgagtgtggctcgatcaacctgagtattgatctgaaagtatatcatgatggtcatatgatgaatgataattataatacgtaatagacaccagatatgtggcgccttcaatacctatttgaaatattcgactcattatcacgcaccttaataggaggctatgatcaaattatctcataactttatcattttatggacctaataatttagaagatttgatttcattgacctaagaataagagaagaagatgacctacaagctgcaaatcctctcactaacttcatcaagttatatagatgtttaaacacaaactgatttaaagacacctaaatcagtcacactgattcaccttaatagcatgggtctgcacgaatagactagtgacctaatcaaaatataatttatcatgttggccagataagtgagatcagtggaaggaatgtatccttaactcaccgtaaatacatctaagtgaatagctcccaattaaaaatcacttgatcgaatctgtcaaacttaccttagacaccaactggttaattagtttcgatttggtccatcagaagattcgggctcaaccacggagccatgatcatgatccatttattaggatcaaacatatggacttgatcaaacttcaactattgaaattgatttaaaaaaattctgatttaatctaattcaatacttaattagctttagtcaatttctttacttgatctatatgtatttctaaccctaggtctaacccattaaaaagatctgattcaaactaatcctttgcctattaatttatgtagtgtcttaatgatcttcaattctcaaatctagatcattcaaagcttaattcaaaattgtgtcaaacatgtattttaatctgtagaactattctaccagcatttcaagtgaagtataccatatgtttcaactcatgaaaataaatttttataatatgttcaacaattaaacatatataggtatgatctaaacttcatacatacatctcatgcatcatgataatttttagatcaataccgattacattttatgtaacatgctattcagatttaaaataattttatatctgaattttattttattataattaattataaattattttaaatctaatctaaatatattttgattaaaataatatataaaaatttgttcacttttttttcttcatgaaatcggatcacaatgacacccctacacatcataagagaacccatcgaatagataaaagagaaattaatctctatgatctcttatgaccggatggtttagtgatctcatcaatccaagtactagactactaagatctaaaatttaatttcatatataattacatcaatatgtaattattgataaaataatttttatgtcatgaacatatccttgatcttattaattatatttttcatctaatctaattagatttgatacatcatatcaaatctgaaacacatcttatactgattataaaatattaattttagatttaatattatatagaaaagtaattagatgcaaacatgaatgtatgaggaataaatttctgataaaatctatttttgcgtagtgctgaattttgataggattcagatctaaatatctattgaaacggatctaatttagatctgaaataaattttacttcataatgaaaacaacaatattaaaattttattaaaataaatttaaaataaattttaatttacattattatttcatttaaaagtttagcaacagtaaaaattctattataacaaacttataacaatcttaatcaacaattgattaggctcatctaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagcaataatagttaatttattattatttttaaaaaataattaaaaaataatttttatttattattaaaatcattgaaggaggggactcagactttgacactggagaggggttgtgggcgttcgatatagagttacgggagcagactcaaactcattatggactgagatgcctgatgtatttatgtctctcttatgtggcatcaactcctcaccaaattgactaaacagaaattactataaaaattagagtcaaaaatattaattttgaaaaataattttaaaagtataggccacagctctctagtgccccccccgcatatttttcaaaactatttttttaaaaataatattttatcattattttaaaaatataattatttttattataaaaataatttatttttaaatatttttaaatattttattttattttatcattttatttttttatttttagttattttaaaaagtatttttagaaattatttttaagattatttttagaaagaattatttatgaataaattattaattttaaaaaatataaataaaaaatataaataaatatataaaatatataaaatatataaaatatttttttgaaaggatgactcactagaaatattttaaaaatataagtaaataaataaataaaatattattattattatttaatacttatttttatttttattattttattattattattttcattccttctccttcccccacatgccacaaactcccccctcccccctgacggcaccgggctcctccatgcatgccacccctcgtcgcacctccggcaccacacggcagccccttgcagccctcgacgctgccccctggacacccgcaccgcctgtgctgcccctggagaccttcatcgccccctctccggtcacttgggctacctcttggccacctgcaccgcctttcgactgctgctttgtgccaccgcaccgcaccccaaccgcctggctgcccatgccgcctccagctgcccacgccgcctccagctgccctcggtcatcttcttcgtttaccccctccattcgccaaaaaaaaagaacatgaaatcatcggtccaagtggcgagaggaggctatcgcgggtagtcactagggaagggaggggggccatcgtaggtagttgcttgggaggagaagagggtgatgattggcattaccatgctctctccgaggcttttgtcgggaagaaagaaattgaagagaagccacgaaataggagtattcaatttgagggcattttggtcttattaagggacttaaagttaaaacttcatttgtaatggaccaagagttataagttgggtcaatagggattaaaaattgaactttggtctacaaatggataggacattaatttctccataattctcacaatgatgcctatgagataaacatggtggttgatcgcatttgttgagctcgcccctaacaggatcttgatacacaatcatcgtacctgtattacttaaggtagagttaaaataggtacaatatatgggattaatagatcgataagtgaagacatttttcatacatgtaaaatatattttttaggaaaaaagcacatggttacatcaaaaagaaaaaaaatatttttaaaaaagtagatggttatatcaaaaagaagtatttgcccaatacttgtgatttcatcaatctttaatttctaaaaatagtttaatactatatgtgtgtgtgaggggggggaggagagagagagagactgcacggtagtgtgtttagttccacataaatcatgtattggataggttgtgaatatctatgcaaggtagaatagcccaaataagaccctcaagatagctttttgggataagatctcggattgttgtgaataaatatttctattttctacaaataatctagtataccaaatatttatattttaaaataaaaaaatatttttattttgaaaatataaaaatataaaaataccaaatggccgcttgccttatacatataattataaaagttcaaatgcaataaaagacaatatagtatattaaagaaaagaaaattaaaataggtaaaaatatatcaaaacaaaaacaaaaaaaaaattattggtacctatttgatttgtgtttagccaacttccaaagaaagatgtatgagttagatatatatttaaattaagaaccaatctcaaactaggttaagtatgaatcacatcaaaatggattttgaccctattaaatctagatggacccaatttagtgctataaaaagtagttaaaaatctctgagtttagcttagttagggtgtaaatcatattcaaaggtagggcaaacataatataaagcattaaattttttatcaaatatcttatggtcaatacttatctagttaagattttggtcaaacttgataaagacttcctattatttttgaaattaccatttaagatctaccaaaatttttcccactgagagaaggaaagtagacccacttgaattgcaaatatcactaaaataaatgaagtttatagcaatagaatgttagtaacactcaagagcatctattactctaacgctttcttataatagtttaaagaaatattataaaaaatatataatataacaatgtttgatcaaaagtgtttttaaatattgttatatagtgatggcatcttataactcctataaaattgtatgctaaaaattttatgttagatatgtgctctagaagctaattgttggttgacacattttataatttcagaacaaaactttatacttataaattttttattattaataaaaaataatttttatttcaattatatttatgtgtccatgatttgtcttaaaaattaataaaaataatttttgtatattctcaagatgttgagaatttgagacatgcattaattaatggttagtttctaaatgctctcaattaaagaatcgtcatagggatagtgatcaatctatttgagattgatgcatggatcatctttctttcggatagataagtctcagatctgcggtatagagacactgggatgagagtgcaggccagtggttgttagggaacaacttgcactgagcgtgaccaatatgaaaaatcatttggatgtctactcacttgtcagtgttatctcaatgttgcagtggtgtgagtagtcttttgacctatggtgtcatcggctattcacagcaaggttactgagtttgactgtacgttttcttggtctctagccattcggattcttgctgtatatattgactacagtaggttcaggtttgctgtttggagtaagatgtacctagataaaatttatcgatcttgatagaaaataagaagtcctatacaatttgcgagattgagttcaaaaagtctctgaccaaagcaagtgtgaatactgaaaatttttttacagaattcacaaatgaactcgactcgagccaatcttgcatatgactgatgatgaggtctgacaaattttttatgatctctatgagtcggactcatgatagaaggattgaattgtatgataactgcacctacgagttcacacttttattttattgaattgtcactacatattgctaggtgtcactgatggattatgggactcatcggatgtcatcttgatgatcgatgaccctcaaagaatagagttaaaattatttcaatctatcaaaaagagtttcgatgatattgtgacggagattacaatatgtcttactactagatagaatggaacctatggggtcacacattaagagatttaatcttgaatttatcaattagacttgtgaagttgtaattgtgttagaatttattgaaatcctattaggtttaggagaaccatactagtacatcattaaatttaattcttctctgaacttcgattggatcaagtccatagtcttgaacctaacctaaaactatttggatttaactggacacctaattgtcagcccaagaggattggattaagttaattagttggttaaattatctcttcattatctttttatttattttctaatattatgtgtggaattataggaaagaaaagatggtactatgcctctcttttggaaagtccaaggggcaccaacctttgattggcatgaggaagagagagaggcccaacccctctcttgtattggcatagaaagagaaagaaagaggggccatgccccttctctcttgcatgaaaatcctaagagggcgtcaagtgttaggcaccccaactatctgtcctcttttatgagagacgcccactcagtctgccttatctgactggggcactccatctgcttgccaaactaataaatagattttttaattaggtcttattttttcgaagaaaattagattaaaaggtaagagaatttatgagataagatctaatctttttagcctgattggataatgatttggaatcaagaaaggcctatttaagaagatggtctcttaggattctaaaagattgaattttaagaattctaaactcgtcctgccatatctccttgcctcatcctttctccttcttctctttcctatgcccaagggttgggcatccatcttccacatgtctaagttgagaaggttttcttctacagtaaagaacaaagagaaaaaggctgcagttcaagggttgaagttgcagtcaagatcaatagttgatcaaaattcaaagaggtcaagatcttacttagagaagaaagatctaccatggaaagaaagattcaagattgatcttagtggatatctgtagaggccaaacacgtgtacggctcaagaactttcggatctaagatcatcgatagtgatgaattttaacctacataaatgtatagagattcactctcatcttttattttatttttagattatatgcatatttttatttctgagctcggataggattagatatgatctaatgcatgtggggttaaaggatttaatccgatttcttttcgctgctattcaaaaaatttttgaaatctatgcatacatcttatctgattttctaacactttaaaagttatcataaaaaatatataatattataaaaattatttgtgaatattattaaaattttttatgttatgatagtaccttatgaggataatattttctgattaaatagtaattaattagtaatatatagttttctagtagaatactgactatttatcattgttaggatttgatgcctcgagattcagcccacaatgagcccacagcgaggttcgcggcgaaaaacggagtccaacgagatcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtataactaatagttttcatttctaattatttataacttcttttatgataaattatgttgttgtaagctgatttagattttttgcaatgataatatttaatcactaaatatgtatgtaagtttttaaaaataaatattatgtatatctaataaattttaaaagtaacgaggtttcagctagacacattgattgttatatatcctatttatatttaacatttttttaataggttaaatatattattttaaacttcatttggccaatcctatttactaaatagttacgtggtcgatcatgtcagataaatagtaagagaagtatagattgggtttggtttgagtttttaaatctatgataccatagttttatatacattaatgattactgaatcaccaatgatgcattacaattaatttattaatatagaagggtacataattaatatattgtacttactatggtgaaaaaagaatcttaaatgcttattggttaagagagagctagtaaaattaataaaattgattatatattatatttttaactaaaatttttgatgcattaaagttttttatttaatttaatctaattcaattattaaataggttacatgagttaagtcagtttaatccattatcaatgttacaagtgacacactactatttagtaattatgatttaagacataattattaaaaatttgtatggaaaccgatttaactaagaatttggaacactaatcctacatgatttgtatgaaaaatataagaaaacttaaagttttttatataaaatataatataaagtattaaaaatattcaatattaatagcattattttttagttttgttataaataaaaagaataaaaatttattgggacatccttcgattttagttcgatttcaattacacctcctatattttaaaaagtgtcaaatgaacctttctatttaacaaactattttaatatggtcttactatctatttctattaatgaaattgtatcatgtgaccttgacatgatatcatatttttatgaaatgataatgatatccttactatattgtaggcaataatctaagagtagttgaattgtaggcaataatttaagcggtctcagatttgatctgtgatagaattgtatatataaaatttttcacatatttaaaaatataaatatatataaaagtgttctatatttttttgccattttttatcattattatagaccatttttgttgtagtatatttaaatacatgcttttggagatgcaccatcaaagaatgaaaaaaggacctctgattgctacataaagaggtgtcaccattgagctagacttctttaatgtaggaggatcactggattcattgtgaattaatttggctacacgagtaagtttgaatgaggttaaaaagtaagatccattgcatcaaggacctaaccacaaaccctaacttctaaaggtcacaattttctcatatagtattccttttcagcattcaaagtgctaaattgaagcttaatagctgagtaccataaaattgcttttttgatagtcatttcatataaaatttttaaatttaggaactatttataaaggtcaaattataatagcccaatacttcataaattgaaatagagccatacttattatctggatgtcccaatccatgatcattatacggatatctaaatagacctttacttttttttcggtcataactagcactgaactcccgtgttgtggggatttaattgatagtaatgataatattatacattaaaggttgctctcaccaatcataattattatatagatttaaaatattttttattttttatcatactatttatatttatattttttatttaaaaaatataaaaaataaataaaatttgatatgtggcattgcagaagattatcctatagtcttacgtgtcaacatggaatgccattcctaatactcgtgtatcgttttattattattatatagatagatagatttaaaatattttttattttttatcatattatttgtgcttttatttcttatttaaaaaatataaaaaataaaaaaaataaaatttgacatatagccttagaaaaaattatcctataatattacgtatcaacatgaaatatcatctctaatatccgtatatcgctttataattattatatagatagattagtaacgagcttttggatgttgtttcatgggtatacacccatgcgaaaggtttatcattgtggctcattgtccatgcatcaatttccatttcaaagggaggagatgttttacgtacgaactttaccatgagggcataacaaagctataacatgaaacgccaagccaccgattagggtaaataaaagtagaataatagctctctctctttgttacacatcgtttcttggaaatatttatgtacaagacatccttccttgcccaactaattcaaaggcttgacataaatattagttaggcaacacctaccattaatttacaacattgatagtatatcaaagcatgctggtaacaacacaatatgcttatagaaagatggacgaaaaattttaattataacacttactctcatggtatatgcaacctgtatagaccgatctggttggaagctgtatataattgcaaggcattctaactccctttatttagtagaaaatgtggtgcaagactgaggaagctggggtggtccgggccctacctgaggcccagaaggggagccattgctaccaccaggaccattggtgctcggaggagaccccatgattgacttgatagcggcagccaaggctgtagtgaagttgggatctgctgcaattgctgcggtgactgtctcaaccattgactgctgccttgggccaaactgcaccgccggcggccccaccactccaggcagcagcttatgggggaggtacatcgatggcggcatcgagaacgggattgacggcagatggccccgcgagagctggagtggactcggggactgcgttagatcgagggtgatggtggggaatggggcggaggcggagagggtggccatggtggaagcatagggcacggattggaagaagccaccaggggtcatgagggagtctttgctggtggtggagccggagagaagcatggcggcagcggcggacgtagtgttggccatggcagcggcggtttgggggagggggtggttgtgggtgccctcgtaggtggttataagaatggtcttgtcctcggcacatctctgcacctgttgcaccaaaacaaattttgataaataggatggcctctagaaaggaatccaaataagttttatacatagaaaggtatggagaaactctatctttgcacaccaaaaactttagaaattttctagtagctaagttacggactagtagtgtattttcttgcgaaacaatggagtagttcatatattaagcataaatttttgtcgcagatcatagtcccactcgtaaaggcagtaaggaaaaaggaaaacctttacgagaatgtttagaagatatttgaaatcctgtcttttctttgactgctgcttttttttttttgactagtatttgatgttcagctaattatacacagtcgacatatttaatttctggacctagtgagcctggtggtgccgttaccaggtctatcctgattctgtatattggtgtctttggtacaagttgtgaataagtatgtacaaggctaagaactaaacgtacaattcctattaaaatcaagcaacgggaataaaataatttaatcaataagaatttaaaataaaaatatataatggtctatcaatggacaaacgtcaattaccaataatgctaattataaagaaattatcaagacttagacaggttaccgtgtcaatctgcgatatgatatatatgcgtacgtacgtgtgcggtgttggtggttttatttgagttgtgggggaggaagagagggggagagaccagatacagtggcactgaagtagcagttttaggctttagaaatcccacataaaatttttgactaagccctgatcaaaatagatagacttaattaaaatgctaatgatgacagaaatcaaggacatcatagtggagcaaacagaggggagaaataataaacaaaaagaaataatcatcccccgcattgcaaattaaagagatctcaagatttagggttgtctttttgtcgtcaaaatcaatagcaaggctaatcaccacggctggaatggaaaactcaaagttcctttgaattaagaaaccatatatctgttgtttgagctgtaatctgagactttgagcaatttacttgttaaacaaacatacagcccaagatgaaggcaataaatgaggcatctgtcaatctgtgactaacaaccggaggaaatttttagttgactttgacttggtgaatacacaaccaatggtgagagttgatgatctgcctcatacattgtttgaagtcaccctaacactttcaaaaacaacggaatatttaaagatgcctcacgaggaaggaattttgaaaaatagtttaaaatatccagaaatacataataagggaagattaacggaaaaattttcaactgttgatgaagacttcctatatgcaatgaactggccttataaggaagaatggtgagatatataggacctaagtaaccaaacccaaaatatgctgcggttatgcttgcttatgtatgtaatttaatgtgtaaaagggattaagcctacaatattagataaagtcttccgggattgcactaagtacaacaatttgcagatgccaaatgtaatttcattacacagataacgaaccttttgacaggatccttggtataagaagcttttcaagtagataactgctatatccaaaggcaagttttctaccgattgcacctacctgctttcgaacggggcaaccaacagccatggtgcaacgataataggctcgtgggcatggattgccctttgccatcttctgaccatatttcctccattgacatccatcagtaatctgcgggcacaaaaccttttgccttagttcacaactgtttttatgtatagagtaaatactgattgcactaatggttacgtaatgggagtctgtgtttaccattggggcatcagatcgtgcgcgcactgagactcttgctttgcggcatgggagctcagtgtcagtgcttgtgtcttgcattagcctcggattcttgttactcccccagctaggtgatctttgctcggagggaccatcatcaacaggtagttgtctcttggtgagtggaataatgccttgctcccttgaacctctgttgacgatgttgttgctcaaagattgtgattgttcttcatcttcagcaccagaatgtccgaagttctgcatgctagtttgaccacgttccatgaattggtgttcggatactgccaccggactcgatgtatcggtcttgttgtcctatggatggataagaaacatattaatctgttgttgtaattagaggtcataatgaaaactatcaagatgtttctaggaagacatatataatatgttggcaaagaaaaagaaagacgaaatatgcaatttggcctacaattgtttgttatgatccaaagcctattgtgctgatttgatctgaaagacacctcagatgagattcattaggatgatgctccatgatgcgcgatcatattaatatataggaagaaaacaaatcaagagaaatataaatccatggattacgtaaccatatataccagtacttctttgaccattttatttcatgttttcatgctgcaatgaaacatatggtgaatttgctcaaaaagaaagaaatgcacggtgaaactcacactattttactttagaaaattgtcagatagaacacctttctttggccgtatacaaacaatgcaaagagggaagtgtttctttgagaaagcaaagaaggaagtgtggaaatcataatttttctatttttccaagtcagatatcaaaatatttcaaagatgaacggcgaaagcacattgatttcttcaagcaataaaaatcctatttagtacgtcacatttgtttcctcataaaaagaactatgtcacgtttgctgttttgcaagagaagccacaacctaactaatgtcattttcatataaaataaaattacaaatatctataattattttcaagtgtacaaataatctccttttttttcttttcttttccagatatactcttgcgtctacatgcaaggatatttaatcgactatgtgaacataaatgaagagacaaggaaatcggaaggcgcctcttgtctagatgcgatttatatatgctctcttgggcttttatggtatcaatttctctgcggtgaagcagataagattttcaaaaagagaaagtagaagaaacgagagtgagatcaaaaaagaaaaagaaaaagaaaaagagagagagagaaaaagaaacctgtccatgccggaaatcctgtgcccgttgttgcatggctaaaatatactcgttgtgaagaacaccataacttctagtgagctgctccagcatgatcctcaatctccggttctcttctcccaatcggtttagctccccttgaagcatggccagctagaaacacatataattcacgattgatccctaatcttacatgaagaattccatcttgtcgaccaaacaattagtcaaagcgcaccttgttgttaggtttcttctcctcttcagctccctggccaacccgtgagctcatggtcaaaagatgcaacgcggtctgccgaagaaaagaagaaaaagcactcttagcagtcagtctaacaggttcctaattaattatatatatatatatatcttatagaagagaaagcagtggtatggttatcaaaacatgtcatctttccattagaactacaatagaggaactcgatttatatcgagataagatttgactgcccaataattcaatacttacgttgatgcttgtatcttcctgaggtgatacgttctcccctcggggatcatgcgaaacaccagctcgtgcatcaccaccatggttgtctcttcgatggctctccgagaagaaatcgacctcttcgatcccgtctctccgatcgataccctcgtcaacactgcaaccacgctcatgactcgagaagctgtcggaatataagagtgccatttccttcggcctctccattggggagaggaagaagagggagagaagaagagagggggagggctctcaagaggtgcaagaaacaaaacagcaccaagagaagaggagagagagaggattggagtctttgaaagaaagacggttcgggccaataaatggcgtgggcagaggtggaccaggcgttgttttccgtggggtctaccccggtgacgtcaactttgacgtcggcgtgacagctggcgccgtatcggacccgtcagcgctggaaacggcgggaacggagaaagtatcccccaccgttagatctgacggcctcgggggggaatcccacgggtggcggggtcaacgaggtcggcactcgacggcacggctctgcgacggtgggtagaggtggggcccgccggcacctaattccccttgactccgtggagcaccacgtcgcctgatagggacacgtcgtcaggggagggagggctacgcttgctgggccaatgctttgagagtcgtgcactctcatatatgtggtgccgttgttctactccagtagctatggaaaataatgtttctatcaacgaaggggaaatgtacttgatgaatcttttattttgctggaaaaaaaggcatgacttagatatatctgctcacacgtgcaggcaaaaaaaaaaatctatatacacctatcaagcaactatacaagttggaaaaggtgtggacgttagtggactcatacagctttagcgttttaccttcctcctccatccccaaagagaaatgactttcttcttttaaataagttatccaaacttctaccaaaaaaaaaaacacaaaaaaaagtatttcaaactagtacccagaaaaaaaagttttccaaacctttatcttataattctttgtccttcttgtcttgtgttttctgttttcttaaagacagctatagtaaagaattaatcttttcttttattaagaaagagcttcttatgagaaaattttgaatgatttagaaaatcaacaatttgttcattccaacaccccccccccccctctttttttttgacagtaacttatttttatgtggtgaactagattaattatgtatggtagaataaattactattaggtggacttatcaattcaccaatttcttatgattatatttcatgacgttgatataaagcacaacattttctagatgagaatctaaataagttgaagtctacaagccaaacctattgtctgcaataaatttcaactggatgcatgtgataaggaaatttgattcgggccagttttaacgaaatcataacttcacatcaacacccagtttccaaatggtcatatataaaagggaaaagcacttaaataatttcaaaatttttaataagatattaacttatgtaaataattttgagttataaagcatagaatgagtgatatatggactttaagtacaattttttcattttttttatcctcatataatgtttattccaaaatttaggcttgttcaacacctacacattgagttgaggcatccaaaagatgctaccgatcgagcactgtcaccggcttaaccaaagttatatgtctaaataattaactaagtatatacttgttatatatagtgggtaagcattaatcaaaaggaaacttacctaacaagtgtactttgtgtagcacaattgtattttaatgcatgactcagatcatgaaggattatttaaaatggagaaaatcatttcagatggggagatttacaagggatgacaggcagagccttctttcctattaaagtcttggatagagccatgaggcgcacgtttgcaccatagtttaatgttatcaaacatcccatcgatgaaccaagaagcgaaagttgggtaggacgtggaagaagggagaagagtacacctcctacttcgtatatttgtgagatggcaggtactcaaatatatgcatccgttgagctagctagttgtattgttatgtagtatatatatattattattttgtaagataactagcatgacaaactaaagaaaggcaggcttggtcgtttctttacatgtgaacactatatgttagtcaatgccatctttatgaagggcatctactttccccatcaagtgaagatgacctacgagaccacctccaattcaaaatgacttacaaaacactatatactagtcaatgactatctttaatatccaatacctaataatccaaaatgtacaattcaaacattagctcatgcttgcttcttcttctttctcttctagtagaatggtactgaaacagatgctatcatcataaatagtcctgaatgccaagcaaatcctgagtctgagtgatcgggatggaatagggatgatgacccaagtgccacaatgattggatgaagccaggaaggaaacaaaatgtgatcaataacagctctacgtacgtacactctcttttgctataacatagtatctaagaccaaccaatcgataaaatagagggcattttatttataaaattattatatggatatgataatatattctaatattttaagtatttgatttgatataaatgtcgtaagactttgttgcacatatattgatgacggcgtacataaacaattgtttgaattattcaaaatgatgcaacatttaattcaggtaaaaatagcaaacattattttttttgtgattaattatttctatattcaggtatatggatgaaacttttcggttgtttgctactttcatgcattttcagggttttcagctttgataatacctacaaattaataaaaaaacaaagaaaaaaaagaaataaccatagatctcaaagttttcgcactgcctgtacgtcttcctgtatatattatttttattctcaattttatttccttgagacactccttatacgttcctctcacatgtcataatataattggtgtatggtagtattaaaactgtgaacagtagtattaactaacatgcatattagtattcatagaggtttaattgataatttgaaagcaattaaccatcctatttggctatatatgaccctaaagtcagtcccagaatcacccttatgcggcatatacattggactaatcaagattagattgcttttcgtgcaataatgatcttgttgccaacaaataaaacaaccaataagtccatttttgggcacttgtgggagagtcatcaaagtcgatttgtcgaccaatcttcgaattttgtttgcacgtaaacgtcgagctgataattgacgagggtcacacggactaattttaaattagacttttaaaggaattagttagtgagtccttagcgagtgatagagatcttaaattaggcatcacaaatagctaggccatatgtagcttctctggttcaatattgtgatttgtgatggattcagaagaagggggaaagacccacgggtatggatggtcctggggagtcacatgcgacgtggttggagtcaagcagtggagccaaaaagctaacgaggagatgaaagctaagggagggaggacaaaggctgtggtaaacgaaagcggcgcccgagccggcactcaaagacaaaggggtgaagaccacccttccatcgagaggggcatggagctggatgagagagagagagagagagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcatggagctggatgagagagagagagagagagaggtgtttggacttatttgccctctcactggttcccgttccatcttttctggttttgaaacgagttgaatgggctcccccacatacgacctcacgacgtccgcatcatttggacgccaaaggataatcgcacgaaatttgcatgacgcatctactttatgtcctccttttttttttggtaaaatagtggaaggaaatttcgggtgcttttgtatgggctcgttaaatttctttatactgaccgatgaactttctaatcgttatccataacaagtatctttctaaaatattttagcaattattatatattatcggtcgttttggtcaaatgtattaacatcaggatgatctatatgttagatgagatatctattctttcacacaccttatgttgaaaacctaaaggcttactttgccctaattatggcaaggaacaaagataggatctcttctcacttagatgtcctatttcttgggagaaacaagtttaaggtcaaattatcttgaaacacacatctttgaaattatgtaaagctaggatttcatttcggttccatcactacacctctcagagcaataatctaagacttcagctttattttagatgatttatccttacgaaaaaagcattgttgatatttcaatatgtccctatcatttaactctttctatacatatggacacataacatacatacataaatatgtgtgtatgcgtaaattagccaattaacattaacaacaacggggaacaaatatttcagaaatattagttaccatcataataaagctaatttcaaggaagtatgtatactagctttataaatttagaatatgcattttatttattaagaattaaggtgttaataagtaagtatagtatattcaaagaggtgtatgcatgggatctctttttccctttttagaaatggcatggtgttataggcatgttcataggagcaccagaacgatgtcatataatttcaagattggcccggattatcatatataatcttacactggtttatagtctatgagagaacattagaatgtagtagcaaatgattgatccaaattaacactatttgattgatgagccacactcatgtgtgtatgtattggacttcgaaagatttgttctatagatttgtctgagttagttcatcactctcttctcaatgaagaggctttaaattcaacttaagatgatggtaaggccaccctagctctcgtaaaaaaggcaaaaatcctataaggtttaatagtaatattttgaggagtattttaaatacgtagtcccaccttggacttgcatgtaatgatgagggattgtggactagctttttttaatttttattatctctcctattgatgactatactatatttttagagagatcaaaaattaaaaaaatcatggttgatggaccgcatgctaaaatgttggtcaatcgagtattttgttaaagtccgatcctagttattaaattttttttttaggaagacaggattagcacataatgatgaaaaaaatattcgttgtaattgtgataccacgacaaatcaattataatctttatatttcatcgattattgtgtatttcatcaatttttatgaattatactccatactattcctatgtatttcactcatttttgactctttattggtgattaatttgttacaatggtgacgtggtatcaccgttgctgtgaatattttctcacgacgatggctcaaaggaacacaaattaaggagcggtatttatttcagttatatattttttcagctacgaaatattataataaaacttttatgtaaaagggtcttaaagtctttccagcatttggcagccgttccgtgtgtaacactcctacgtgatgggatgtgacaaagcgatgcttttgcctttatacccttcctttgcaccgttgcgaagggttcaagtatatgataggtttccagaagggagaagaagtcacaagtggttggcccacgcagtcctctttttcttaggcgtttgaaatgcgagtgaccctggaaaggaacttctctcgctttgggggtatcccaacctcccaagcatatgactttgaaggctctttgaactcacatgtattcttttcttttctattggcttgcatgcaaaaggacttgacctaccattggcttggcatattgcatttgttgtcttcaagccttttgtctctccttcgcgttggtgtcaagaaagttaacatcctagaccagcatccaccaccttatttcttttggaagaattcttggtgactatatttaagccttcattgactgcccttgattttttagaaaattttagacagggttcagactggaccaatcctctatatatccttttgttcaagacttgcaaaaaaccacaattaaagtgcattatgggctaaataaatacctacaaaatcaacactttcattcattttcagcatttataaaggttgtaatcatacctgtatctttcttgtgaaaaagatgaaaggcaagatataagccatccggtaatccttcataaatttatgaataatctatgatcggcccccttttgatataaaaataacttggatgatcattcatgtgaaattgtgaatattttcttttgagaattattatccatgagtagtttgttatatcattaatttagaaggatgatcagacttgatgtgaattattttgtctactatggataaagataaatagattctactagtaagatccaccatatcggaaagtcaaacctccagaggttataattggatgatacaatcatcgattaagatgatttttttttaaaaaaaattagatgactttttaagacctatgatatagcactattctcttaaatgggctacatagctagtgattagatccaaatttcattgtttgggcttctaaataggccgatcaaatcaaaaattttattttcagaaaagattatgattggatatatctttcaatttagcaaaaaacagatagagtgatagaaaacaaagttgatgtaggagtagagatttatctctcgtaaaattttaattttttcattatttatttatactagttaatatttttttagaaagttaattctattttagctaggagaggaatcttttttgaattgtacaagcgatcttgcgattataaataagtggtatataccttatttttaaatcatcatcagcaaaagaaaatgggatctaaacctcattttcactacttttttcatttttttttttgtagaaattcaagttgattaatttgctagaattttttttttctccaaccggatcgatcattctcaatgatacaaagattgttgtttgttcagaccgactattttccatgatggttatttttaatgtaatttgccaaatggctcgcatggatccaagaaaaaatcaatgaacgtcaccaaggacaaaatgaaggctatatacagagtcgaaaaataatattggaaaggacaaattaaaagatggtcatttgaggaaccaatagtttggaacaggtgaaagaggtcatgaagcgtgtcatggactcctctttgtggctttcaagggctattgcggatgcaaattgcaagaagatctagcgaggtggtctggtcatgaaacagagctggtggacgtttaacatgtggtttggaagcatctcaaaggaccacaagggctcgttattcttgtcaaacaagaaagaacaagtggtagggggatggatagaggcctccgtcctctcctcgtctcattggcttaattagtctcctttctgattaatttccttatcctcatagctagctgctggaccatgaaggaccactagtgtgccacaatctattcagccgtccccctctatctctctctctctctttctcatattcatggagccatctctacctgcttgaaggatacagttgctcaatttttccagacgtgtccactcacctaccatgaccagcgtgtgccaagattcatgcacacatgttagcacgcaagtcatccaaagcacgtatcttaatatatacgaaggaagagcagatagaggtgtgtaaccgtcaagaagcatgcttgctataatttttaatggcttgtcatgaacatgattgatctctaattgaagttaatgaccccatcaagtgcccatcagaaatggtcatcacatcgagttatagtgcaaggattagtttatatcataatagaacaaaacatacatccttttcggaccagaatggcctgtagcaatgaaacattggcaccaaggtggtttctgttttttttttttcctgtggacctgagatggttttctgatataacaaatgtgtgggtctaagatgaattgaagtgagatggagctgcaaggatctaggtatgtactgtgatggcatcaaacaggacccatgttgtagaaaacaaatgtgactacttgttcaacgacttaggattgccaagaatttctatggcttttggtagttatgatccgatttagccactgagtttgggggatccaaagtccggtcatccagaacttagtggcctgttaattttagttcatggcctgacctatccatttggccaaagatatatccttcaccatgaggctatctcaataataaacagtagtagttaagtccgctctctagctaaaataagaagctcgtctagcctgattcaagcctaacctaaaacttaaagttttggaatacgttttccaatctaatccagtttgacggatataatgaaaattttgcttaagcactaccagttcatccccttgtcatccctacgactaaaagtggaaaaccaaaaattcagattagaaaattctagctggttgcataccgaaatggatggccaaatttctcaataaattatgttatgttggatttagaggcatctgtcttacatgaagaacatacgcaacccaatatattggttgatttgtcaacggagatctaagtccaggtctgtgttgggccaggctaaggttgactaatcattagttttccagactttctgaggagttatgtaatctctgaactgtcaccctaaagaggctgtgttattctttcttctcgctttcataaaccaggttgctccttgagctcccttccaatccaagaagaagaagaagaagaagaagaagtttattgccaaggggttagagggacaaatacacctaagttttctgaatttccttgcggttattttgttgttagtttaatttattagaagaatgctgtcttcttattgcaattctctctactgttggcttgcttattatagtatttaattaaatgacctgatcagaggttcgagtcaaggaaatgatatgttaatatgttcccgtgatatttacccattctctaatatgctgatgattctcttatttttgccaaagcaaagagagaaaatatttctgttcttaagctgatcctttattgttttgaattgatcactggtcttgtcattaactatcaagaaagttctattgtggttattgggccttcaaatagtccagcatcaatctttgcctcctggttaaactactgtctctctactgtacctctaatttatcttggactgcctctcaaagaaagtcggctctctaattctgactctctaattctgattggatgccacttataaatattagatgtatgtcctaaaaaatcaatatggtatgatacattataatatttttaagatatatatttgtacttaaatattgaatcgtcaataaaaaataatttttttatccatttttattaatgtgtccaaaaatcatcctaagaattaataatttttattaattcttaaattactcctaattgatggatcattacggagatggtgactgatccggttatatcgatgcatgcatcactttcttcggagtagacgagtttttagtctacagtgtgggaataatgagcgagagtgcaagtggttgttagagaacatcggtactgagtgtgatcaaatgagcgatcacgtggatattttctcactcgtcaatgatcgtctcaatgctgtagtggtgtgagtagttttttgatctgcggtgccttaactactcatagtgggattgcagtattttgactacatataaatatggttccttagccatttggatctttgtagtgtatgttggctacagtaggttcattataacagtaggatgcgcatttagaaaggatctatcgaccttagtagataaagagtagtactatgaaatttgagaggctgggtccttaagtttgtggccatagcaagatgatagatggaaaagagtttctatcggtatcatgctttggacttaagctaatcgaatttttcatatgatgaatgttgtgatttgatgagttttcataacctccatcctatcaggacacatgatagagaaactaaatcatacggtaactatacttaggggttttaatcattctattctactgaattgtcaccatatactgctaggcgtcacttggatcgttctggattgatgatccttgatagatgagagttgaaaatgttccaacccattgaaagctgtttcgataatactatgatgatcatggtatatctcactagcaggatgaaaactataagatcacacacaaaaggagtttgattaaattaactagttggatcatgatctaaattatcaatcactggatcatgattgataatttagatcaacttgtaaaagttacaagcactggatcagctaattgttagctaggaggatctaattataaatgttgcaatccaatttgatgaggtcaagttggaaaatcaagttctaattaattgaatcagatttaattagtttgggcttgacctaattaagtctaattgggcttttgatttcaagattgaatcctaattagattaagattaagtctggatcaggttggactcgaattcgattcgaattggattgagattgaacccaaaccacagagctccaatggactgggactctctcccttcctctacgccataataggggtgccaattcagattggcatccactccatgtgtgacaagaaggtgaggaagagagggggtgcaaattcaaattggcgcccctttgttgatgagctttatctcttgttgattagctctatcttctctctgatcaggataaaattaggtttgttttaatcttaaaactcttatttgataagagtccaagatcatccaaactctatccaaacccccttggctgccaattataaaaggacatgggtcttgggcatggagtaggattgagatcatttctagatctaagtgctgccgccccatctccttgcttccaccctaatccacatgccccacctcctcctggtcgatcaccctagagaaggaaagagagagatcagcgagaaaaataaagaaagaaagggagaaaggagttctcctgttgtcttccagatcctccgattttgtgtgaaaggtgttcgcgtgttgatccgcgagtcttcttctatgacagtcgaagaaggagattagatctaaacttgaaggagtaagatctacaagagagctagtacctcggggatcttggatgctttgatctactttagccttatgtaaatatctgtagaggccagacgcgtatgcagcttcaacagaacctgcagatatcctcagatctgacttgaagaaagagttttgtgccacagatagatgatttggtcatcaatttaatttttgattattttattttaaaattatatgcatactttcattttatttttcatcatatgaactagatccatagatattagattagatctatgcatgcataagttaaaaattattttaatatatttttttattatatatttcaaaatagttttaaaaattttatatgcatgacacctcaaaattcaatagtagtatcagagtcacgggttcatatgaataaaaaataagttgaaatctgatttccaatcagatgagatctgatttccaatcagatctgaagtcatatgatttaatctgaatttatatgattagatttgaaataaatacatatgaaaaatattttcataattagatctgattttattcgtgcatgagatgtatgaatattagtttagatctgatatatgttaattagttcgatatcgatatgctataagattgtcttggcataaagtttaccccttatgttggaaagattgttctatattgatattgaacgattttagatttaatctacaattatgtatgagatttatgatatatttgaaaattaattttgagatcataaaatataatttcatgcaagtaatttagatctgaaattgagaattaagatctaaaatttaagtaaatgtattattaattagacatgggtaaatcaaattaggtctattaattggattacatccaggactttcgaatttgaatataatagaatccgatcgatttgagtagttgatcaaatcgagtcaaaaattgattaagattagatcaagagttctcaggattaaaataatagttgtagttaatcaagtcgattgatatctatatgttaactcgattgacccaaagatctaattcggctcaatggctcgagtttgaatcacttaagctaatctatttgaaacccattgactaattggtatctaaggcaaatgcttgaaaggtggtgatgaatatttaatttaagatgctagaggcactaaatattgtaagtaatcattaatattattttattaaaaatttaatgctatctagtctattttacaggtaatcgagagtttgaattcatacgattcaatttggactcaaattggttcagatttgagtgaaccaagtaatcagctcttatttcagtgtgaacgcaacttaaagatcaagagtcaagaagcaacctccccaatcaaaggtccagattaaaagataaatggaactaagtgtgaatacgacttattaatcaacagagaagaatcaatatgaagatctaaggatccttattcacactcccatctctcttttcatgaaatcctagcctcctcactctataaatagaaccccaagacctttctctttttcaatcaagccaacgtctaaattcttttcaagcttctctctctctctcttcctcttcttcttcttcataagtctaggggagatactaatcctagcacaacatattcctccatagatctttttttcacatcctataaaatttaggagaggttctaatcctagtgctgctatcctttctctgttacatatccgcttccgtcaacctttcttccttggagtttctgtaccaagtctttcagccatcctatcgctgtctgcacggagaaaaatgaaggattcaaggagacacatccaccatcgggcgcagcaagaagatcaacttggtttagttgtcttgtatcgtaattttttttttttatgtatgcttctttataagattaatgaaaagtaattttatttttcatgcttctttcttaattttttttataatttatttttttttatatttttaaaataatcaactaagatccctatggatatgattccgactcactctatctacatagtagtgagtagggttaattttggtgtgctatgatacgcatcaaattttggcgctgttgccagagattttggcacgattattttgaaaaaaaaatttcaaaataaaaaaaatattttactactttctagatttttatttcttactttagattgcttgattgctttttatttattctttttcaaaatttctacctcatattactcttcgtatatggtagatttactattttatatttagatttctttatttgcatgcatagaaatattttttacttcctataacctagcaatttactactttttatagattagaataatttactatttttatataattagagattttctacttcataaatagattagattcttagccttttatttggattacatagttaccttttattcttaactgtgagattaccttatttgcatagttaagtagttatcttatttattattgcctattattcttagtgatttactattttctatagcttagaataatttattatcctaaaagtagatttgatttattactttatttgtagaatacctacttgccttttaatcttagtatgatttactttttatttagttagaatcacttgatcttctaatatctaattaacctaatttaaaaatttattttttatttcttcttgctaaaagataacataatataaaaagaatacaacgataatacataacacttgactaatataaataaatcaattaaattttaaaatctacttaacatgtttggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagaaagaattataattggatctgatcctacaatctcttactagttcgtatgatcaatttatagtaaattatcatataaacaagttggactgcaccctatctgaacttgtcaacatgttggttactattgaggtaattttgaagagttcaaagagctttattcttgctgtggagcaggcaccttcctcggagagaaaattttttgagaagaaaaagaataagtctatgaaaaaatagaagaaggagaagaggctgaagaaggacactctgcagaagactgcagacaaaaaaagtacttccactgtcagaaagacggccattggaagaggaactgttcgctgtacatacctggagagcctgaagaccaagaatgatgataaatcttcagaagatatgctcattattgaatctaacctaataattttctttatgtctagttaggtattagactctaattcaagtgctcacatatgtacttctatacaggatctagtaggcagtagaagattgaggcatggtgaaatgatccttcagatcggtaatggagcaagaattactgctgaagccattgacatctactctcttcgactaccatcaggctttagattagttttaaaagatcgctattatgtatttgtagctaatcaaaatttgattttcatatctgtactagtacaaaaaaaatttatattcaatttcaataaaaattttgttttatttatttgaaaaataaattgatagcatgagatattttaattcacagtctttatcatctacatgtcgatgcgagtgcaaatataaacaagcaattatgagtgctataggaaataaaagatctagtgatgacattaaccataagtatatgtggcaccttaaactttgttatataagagaggataggattaacaaactagaaaaggatagtatccttgactcattcaattttgagtcatatccaatttatgaatcctgtctttaagaaaaaatgaccaagctatgtattgtgggatatggcaaaagggccactgaattacttgctttggtacacaccgacgtgtgtggcccatttgatgtgcaggtcgggggtgattaccactactttattatttttatcgatgattttttataataggaatatgtgtttttgataagacacaagtttgaagcttttaaaaagttcaaagaatttagaagtgaagtagaaaaaaaataaaaaaatctctcaaagtttttcgatcagattgaagaggagaatattttagtaaaacttttttgagttatctcaaagaaaatgatatagtcttataatggactccttctgagatgtctcaaatcaatgggacatctgaaaggaggaacaggatcttattagatatggtccgatccatgatgatcttcactgacttatccttatatctttagggttatgctctactaaccatgatttatttactaaataagattctctctaaatctatttctactatatcatatgagatatattatgatcttaatcatcttaagatttggagatgtccagcctatgtgaaaagacaaatggctgacaagttagaggctaggtccacgaaagcttgcttcataaggtatcctaaagaatcaatatgatactacttttgcttttcagacgatcataatgtaattgtgagtcgacacgctatgtttctagaaaaataatttatccaagatgttggtgatgggaggttgattgagctcgaagagaaagtctttaaaaaataatgagttgttgaactagatgaaccaattaaaacaatggttcttcctccctctcatagatctagttggatctcctgtcctcttgaaaggtacttaggtatgcttacagaggatctagaagaaatattcttcgtaggagataaggatcatggagacactacaagaaaagagagtttttgcgatgaatttattgacgatggaaatatctttcatcatcaataaggatatttacgatgaaaaattaaatttattgctaataataaattatttacgataaaaattatttttcatcataaatagatgcatatttatgatgaaaataaaatttcattgtaattacatattatttatgataaaattaatcatcataaataataaaatatttattttaattttaagttttcaaatatttatgatgaaaatagtttcatcataaataataaaagtatttatgatgaaaagttaatttttcatcgtaaatacttgttatttataataaaaaattttcatcattaatatttaaaaaaaataaaaaattttaaaaaatttaataattaaagattattgacgatgaaattttttacatcataaataatctagtattgatgatgaaaattaaatttttatcataaatacctaattatttatgataaaaatttttcatctctaatatgtgaaaaaaataaaaaattttaaaattttaaaaattataaattatttatgatattacatcacaaataatggagtattgatgataaaaattaaattatttatgataaaaaattttcatcactaatatatgagaaaaaataaaaaattttaaaaatttaaaaattataaattatttttgatgaaaatattacatcataaataatgagtattgatgataataattaaatttttgacataaatactatattatttacgacaaaaaaattttcatcactaatacatgagaaaaataaaaaattttaaaaatttaaaaattataaattatttatgatgaaaatattacatcataaataatgaagtattgacgatgaaaaattaattttcatcataaatactcacagtatttatgataaaaaagtttatcgctaatatgtgaaaaaaaaataaaaaattttaaaaatttaaaaattatagattatttacgataaaactgttacatcataaataataaaatattaatgataaaaactaaatttttatcataaatactgtattatttatgataaaaattttttatcactaatacatgaaaaaaataaaaaataaaaaattataaattatttgtgataaaaatattacgtcgtaaataatggagtattagcgatgaaacatcaattttcattgtcaataatccactattgacgatgataaatttttcatcgctaatatttaaaaaaaaataaaaaattttaaaaatttataaattacaaattattagcgataaaaaacttttttattgaaggatgtttagatatattatagtaaaatttttttatatttataaaaataaatattagataatttttaaaaaataatatgtgcataagaaaagtatgtagaatattaagatcaatatgtagtaatataaaaaaataaaattaaaaaaatatttaaaaaaattatttttttaataaagacttaattgatttcaatttaggatctatttgaatggttggatccaaaatattatgaaaatcaaaaatcaatcctagacaatagtaaaataggccaagcttaacttataattctgtatatttggtagttggctcatgcatctcatagaattttaggcccaactgtctaaacaaacccttaattggattcaaagttgcaagcgacaagcacatgctggtcacttcaaggcctagatgggatcatccaacctacttgcgctcgattatatataatttaaaatattaaaaatctaatcaaaattttaatttaaaaaatccgaaactgatgatctggttccttgtctaattcatggtttcgaagcctagaaaaatacttacattaagcataaacaacaaaacaagcaaccaagctaaacaacactatccctgataaagttttagttaatagtaagcgtggccgattaaagtggagctatgttatagaagacggcagcatcattaccctagaagggcaacaacgtctaagaattaccttctgttgccgacattcttgaacagcaaggctggatgctggaaaaagagttttatatttataattgctttattctatccatctccatcttatctataatgtaaaatttggggatctcaagctgtatgctttaatattattttttgaaacttttaaatatcttcgtatctgtcgaccattagaaccttttaaaatatcataatatttaaaaaaaattaccaaaatttttttaaaaaataagaattttttcaagtaattattagcgatgaaaattttttttcatcgctaataatgtaattaacgataaaaattaaactattagtgatagaaagttttcgtcgttaaaaatttattagtgatgatacctatgtttttgtcacaaataatatttttgggaggaaaaataattttttcagcaatttttttttacgaaaattatgagcgatgaaaaataattatatcgtcaataaaattattggcgatgaaaattttttttttgttgtaaattatttttttatttaaattattagcaacgaaaaattttttattagcgacgcattccgtcaagtcccatttgaaacccattttcttcctcgatgccccccatcgtgctttcgcgccccccccccccggcgtccccctctttgctctgcctcttcttccaaccgtcgagttcgccaccgtcgccatcctcgatcaccgtcgccatcgcagtcgcgtccgctgataaggtaagctttctttatttttttttttgaggggggggggggttctcgggccatcggtgggccgtcggggatggggggagacgtcggtggggatggggccgggccggtagggactgtgttcgctgtcggtaattcatctttattttttttattcttttgtcgggccaccaggctagtgtggacggtgccggggcccgagggggccggcatagacgggtgggccgggtcgggcctggtcgggctggcgtagatggggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggacttctgaacaatttataaagcttgtaagggatgtatgagagccactctatccaaattgtacaaaatttttcaagttaaaatttttgataaaattgcttcatactaaaatcgtgaaccgatggagtcagaagtcatttgatcaaattttaacattgattaaagtagctcttttcgatggagagagactttcgaaatcatattctgaagcaaaaatatatatgcgaaaaattagacttggctatattcttatacatgcctgcaaaaatgactgtatattattttataaagataatgaataagcaactgaatgtccgaaatttgataagccgagatacaaagctgataataggaaagtaaagaagatacctcaaaagattttgagatattttttattgatttcaagacttcaaaggttatatatgtccataaagatagctgaaaaaatgagatgacattatgagtagtgacttcctgaggagaatatacttagccatctggtcgactctttagtatggaaagacttcgatgcaaagcattcatactttgcgagtgatccccacaatatctgacttggtctagcgatagatggatttaatctctttggcaatctgaataccttttataatatgtggcctgtgatactagttgtatataatgtgtcaccttgaaagtgcatgaaagaaccatttatttttatgtcacagttgattccggatccgaaagcaccaggtaatgaaattgatgtatatatacaacctttaatcgatgatctaaagaagctatgagaaaatggggtacaatcatatgattctgtgagtcaaaataattttaaattgcatgcttcgattctatggaccataaataatttttctgcatatggaaacttatctggatggagcaccaaaggatatcttgcatgtccaatatgcaatagggatgcatcctctttatatttaaagcacagacagaaaatatatttcataggtcatcggtagtttcttcctgctaatcattcttggaggatccgttataaccaatattttgatggtaagtccgaccgatgttcgccacctaaggagttaaatggagcaaaaattttagaacaatttgaagtcattgaaaatgtctaatttgaaaaaacatcgggtactcgcaagtggaagcatactgaagctgagctgaattggacaaagtgaagcatctttttcgaactaccgtattcgaagcagctactacttcgtcataatctcgatgtaatacacattgaaaaaaatatttatgataatatcatcggtactgtattgaacatctagaaaaaataaaagatggtacaaaagctcatcttgatttgcaggaaatgagaatccgatcgaagttgcatttagttcatcgaggtgagagatttttttataccacctacatattattcactgtttggtgaggaaaagaaaaatttctgtggatggtttaaaatcgtaaagtttcctgatgcatatacttcaaacgtatcgcagtgtgttgggaactacgacggtaatatctctggcatgaaaagtcatgactcccttgtgatgatgcaatgtttgcttcctgtggtcatacgtggctatttaggtggtgatgttcaaactgcattgattgagctgggagtgttcttccgagaactgtgttgtcaaaaattaaagattaacttacttgaaaaattagagaaggatatcgtactcattctttgtaagttagaaaaaaatatttctaccatcattttttgatgttatggtgtatctggctgtttatcttccaaagaaagcacttttggtcggaccggtacattatcgttggatgtatcctattgaaaggtaaaaaaattatacgtactttatcatatcaattataagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttactaatttgattagtaattttacagagatgatgtgccaaaaatacggagaatcggacgagacagaccgtgccgcattgtgggggttcgagatcgttcgctcgtcacatggagtacatggtaggtaatttttaatttttaattagcatataatttttagttatttaaaatttttttaattaattctcaaattgcatagagatgctgagagtggcgagcttcctgataggaacgatatttatcagcgaacccactagcaatgattgggggagtggacgatggggagccaagagctctttgtatattttttcaattattttttcattcacagtctgatttttattaaaaaattaaaataattttaatttttaagatcgtaagacagacatgagatctcagtctatttctgagggctcgatcgcacccacagatgatgtgatctgtgatcaggtgctcgatatgagatcctgttatgttagggatctagggtatgggatcactgctccctcatcctcatgctcatctagggctgacatccattctgcgtgcgagtttcgactgacggacgtgcagaggtagattgccgaggatcgacagcaaactgtcatagatcgacagcaggttgagtaccgagctcaggagttggctgcacgcgtcgataaatatcagcagcttcagatccagatgatagagtggatagtacagatagagcagacgatacaattgatgaggcagcagcatgtaggttcgagctccgtcaagtgctctccgtctccagctcgttctctagatgtcgatatttgacgacttattgatatattttttattttaaattttttataattttaatttaatataataaaataataaaatttatttatcaatttattatgtaaattttttatttttatttttttaatttataaaaaatattatacatataaattaaaaatatatattcaaaaaaaattttaaaaaatatgtctaaattattagtgataaaattattcatgatgaaagattcatcgtcaaatatattttactaacatgatttaattttttaataaatatataattaacagtaacaaaaaatctttcgtcataaataattattagcgatgtaaatgtttgtcgcaaattgaatcatttacgatgtaatttttcatcgctaatattatttaattttattttctaattttttttattaaattaatagtgataaaaattttttattataaaaaataatttttacgatataaacttttagtcgctaaaactttagaattaatggcgatgaaaatattttcatcgctattaattttttatttattagtgatggtataattcatcataaatatctttttttatgattaaatttttttatttttaatgatgaaaaatattcatcataaatattttttattagtgatgaaatttttttcatcataaaatattatcaacgatgcgattattggtgacgaaatattagtgacgaaaattatgtcgctaatatatattagcgataaaaatcgattattagcgatgaaaatttttcatcgctaataacctattttgttgtaatgagataatcctaaaatctataatgaggcgatgtcagacatcgactccgagaaatggttgaatgctataaagtcagagattgactcaatatatttgaaccaagtatggaccttagtggatccaccagaggatataatatacattgaatgtaaatggatctacaaaaaaaaataggtatagatggtaaagtagagacctataaagctaggctcgaggtgaaatgttataatcagtgcgaaagtgttgactatcaggatatcttttcgcctgtggtcatacttaaatctattcgcacactgcttacaattgcaatcttttatgtttatgaaatctagtagatggacgtgaaaacgatatttctgaatggatatcttgaagaagatttctatatggaatagcctaagaatttcacatctagtgatggagatcataaagtctgcaagctgtaaagatttatatatagattaaaacaagcttctcaaagttagaatattcatttcaacgatgcaatcaaaatgtttgatttcatcaagaacgaggaggagccttatatttataagaagatcagtgggagtgctgtcacattcttcgtactgtacgtggatgacatcctccttattgggaattacatttttgatcaaaagatgattgtccaaaaaattttttatgaaagatttaggggaagcatcctatattctacgaataaaagtctatagggatagatccaaaaggatgcttggtttttcatagaaaatgtacataggggaagtgctaaagaggttcagtatggagaactctaaaaaaagacttctatctcctaggcatgacattactgtctccaaaaagatgtgtccaagcatatgtgagaaaattaagtgcatgtttaagatttcttatgcttcaggtataagaagcctcatgtatgtcatgttatgtagtcgacctgatactacccttactgtgagtgtcatgagcagttattagtcgaatctggacgaagagtactggatagctgtgaagaacatccttaagtacttgaaaaaaattaaaaatttattctttaatctttgacggaggatcagagctgtggttcgaaggatatattaattcagattttatgtctgattttgatgatagaagatctatatcaaattgtgtgtttgtatgcaatggtgaagctaccaggtggaagagttccaaaaagcccatcattacagattcgataatggaagctgagtatgtcgctgcgttggatgctgcaaaggaagctttctggtataaaaaattcatcgcagaacttagtgtaatgatattggatgccattactttatactacgacaacaatgacaccatagcactcactaaagagtctagatcttattagaagtccaagcatatcgagtggcggtatcatatcatatgcgattatctcgagaagaagtacatcgaggtgtaaagagtagactctatggataatgtggcagatccattgataaagcaattgagccagtagaagactaaagtccaccttgagaagatggaacttaggttagtctctaattgactttaagataagtgagagattgttagatgtatatcctgaaaagtgaatatggtaggatatattgtaatagttctatgatatatatatgtacttaaacatcgaattatcaataaaggataatttttcttttctattcttgtttaatatatccaagaatcgtcttaagaattaataattcaaagatacatattctcaagagttgagatttagagatatatatgattaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggtttgattctcctgtttttttttttccgttttggtgggctgagattgggcttgggcttgggctaggttttgggttatgacaatatctcactaccagacagaatagaacctatggagtcatatacaaaaggagtttgattagatcaaatggttagattatgatcaaattatcaatatgattgataatttagatcaacttgtaaaagttacaagcattggatcagctaattgttagctaggaggacctaattgcaaatgttgcaattcaatttgatgagatcaaattagaaaaccaagttctaattaattaaatcaagcctaattagtttgggcttgacctaattgagtctaattgggcttttgatttcaaggttaaatgctaattagattaggattaagtcgggatcaaattggactcaaatcgatttcgaattggattcgaattggatcgagattgaacacaaaccacagagccccaatggactggacctctcttccttcctctacaccataataggggcgtcaattcaaattgacatccactccatgtgcgataagaaggtgaggaagagagggggcgcaaattcaaattggcgcccccttgttgatgagctttatcccttgttgattagttctatcttctctttgatcgggatcagattaggtttgttttaatcttaaaactcttatcagataaaagtccaagatcatccaaactctatcctagcccccttggccgccaattataaagggacatgggtcttgggtgtggagtaggattaagatcattcctagatctaagtactgccgccccatctcgtcgcttccaccctaatccacgcaccccacctccatctagtcggccaccctagagaaggaaagagagagatcagtgagaaagagaaaggaagaaagggggaaggagttctcctgttgtcttccggattctccgattctatgcgaaaggtgttcgcgtgttgatccgcgagtcttcttctacgatagttgaagaagaaatttagatctgaacctgaaggaggagatctgcaagaaagctagcatctcggtggtctcggacacttcgatctacttcagccttgtgtggatacgtgtagaggtcggatgtatgtgcggtttcaacggaacctacggacattcttagatccgatctgaagaagaagttttgtgctacagataggtgatctgatcatcagtttaatttttgattattttattttgaaatcagatgcatgttttcatcttgtttttcatcatatgaactagatctataggtgtcagattagatttatgcatgcgtagattaaaaattattttaatctattttttcgctgtatgttttaaaatagttttgaaaattctacatgtatgacacctcgaaatccaacaatacggaggtttgactctaaacttataatatggaaaagcaaatttatctcatttggcggaagtctcactcttgttaatgctgtgctttcttctcttccggtctgcttcatgtccctatataaattttcgtcctgggtcatcaagaaattggatagaattagaagagccttcctttggaaaggctcagactcagcaaatggcaccaattgtaaagtcttctggactaaagtttggcttcccaaagaggaaggtgggctcggaataagggatttgaggaccttcaatcaatcacttctagctaaatggggttggagattcctaaaggatgatccaggatggtggaaaaaaattgtagctggtgtgtatatcaagaggatcaaattatttgaaagctggagacctaatagactatgttctaatatctggagggatgttatcaattctataccacatatttggaacaaaactaaatatacggttggtagtggcttaaatgtttcattttggcgtgattgctggattggtttcaccccactgaaaattctttttccaaatatattcaatagttgccgtggtaaaaatggtatggtggcatccttcctcaattctaatcggggaagatggttatttagactcacatcccaatctccattagtgcagcacgaaaaagcgggtcttctctccattctctcagatgtccacttgaatgttgatcaggataagatcacttggtagctggaagcctcggctaatttctcctcttcttccttgtacaggttcctcatatctagacatttgaggtggtctctggctaaaaaaatctagaagagtaaactccttcaaaagtcaaatgtcttatgtggcttactctattgaaaaagattaatgccaaggatcttctccaaaagaagcttcatagaaactttggtggttgtgttctctgttttggagcctgtgaatctatggaccatttatttgtaagctgtccttttagctctcagatctggttttggatatgtgacagcttaaaagtccctgttgtgcgtgataatctaacctaaatatgttcttcttggtgcaaacataacttcaaccgtgatcttcgacaatctatgctcatggtcgtggctgcgttgatttgatgttgccgggaagaaaggaatgcgagaatctttttaaacaaaacttcctcagaagagagggtgttttggaaattgcttcacctaatcagtaattggatggcactttgcaatcaaaaggagttattaggcctttcataaattgctgactacctcttcatcagatcagcctgatctcagctatgattttgagtttactgagtgtattttctgatatcaaatcttttgttttgcttaccacatctatcttctcttgttctctttataacctttggtaaccaccctgatgttttctgttccaactgaagcttatctgtatcctactcttgtgtagctctttattaataaagattgggtggcctatagcctcccacgttctcacaaaaaaaaagagaggatgcaagcaagcagttttgcttgcctgtgagtgcaatggtgttaacagttaaatcagccattgtacttgaggattcaaattaagatatgattaaccatagctcaggtggcttttttttttttggggacaaaaccatagctcagtcgttgtcattcagttattaatttttcttccccttcacctatctcgtgttcttctgatcaagcctaactatgagtatctccaggaatcagtattgttagtggaaataaagaatcttcagacatacataagaactgagctaaatgagaatgtatgatgacttcacaaggaagaaggttgtctttgcatttgtagttgtgttagtatttttgtagttttcttcctagaagggaatcatgagcattctattgataaatttttggaagcacgaataattgctggagtagggacaaggaggccgattgttctgatgtggagatgctgaaagcaactcatttcgccggtagctgagaggtttccaaggcctcagctaatcttccctgagagttcccaacctgacagaattgtgtagcctgtgcacattgccagcattgaggaattttttttttttgctttcttcttctttttttgaaaatttataatggaaaccggcattgcaaagttgaaggcaatggaatagcagcagcttgagagccaactaacaatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaataaaaataaaaattttaaaaaatcttaaatttttaaaataattaaatttttaaacaataacttttttgaaaaatgtcagataattagtcaacacaacggttataacggccgttatttgaaacctctctcctcgatcggtaatttccggcgcccctctcgtccccttccacgctgcaacatccgccgccgacgctcgcttgccggagatctcccatccctaccaggttctctctcaagacctgagatggcaacccaagatctctggcgtcgcaccactcgaatctgatcctcgtcgcccaattctctcccccacccctcgtgaccaatctagggctccgccgtgatccagagttagggcttctctcccttcttttcgtgatctcggcggtacccatccacatctctttgccctaatatacgacttctcgataattccgacgagagaagagcgaaaatgcgattgttccctttcttcctgaataaaaatgcgtgctttttaggacaattggctcctgttattagatgattttgcggtaaatcttgctgtgaactgttatcttacattctggagatcaactcgactcaactaagtcttaattccataccagttgggtcggcaacgtctcactatgtttctaaaacaccgcaagccagcttctttactgtaataacctaacaaataggaagcagggatttcgaaagggatttctttcatcttcataattgtttcatgggttattgctgaagctgttggttggaattacacggacaatgtagattgtccaagcagttcagaatttgatggaagctattttctttactgttttagcgatataaaatcactgcttaagcaacagagtgtagtcattttcttcattgcatatgtttctaatttatacaatcgatatcggtggcaaggagagagtatgaatatagcatttgaaggctcaaatatcggaaaaacctttagccttggaataactatctagatcactaagtcatgaatccttatatatccatattgtacaattagtttttagttgttctgaacttctctatgtatctgacaaaatccttgcttgtttttgagtctatgttcttacttgagttgaattagcgagaatttatcttgggaaaagaattgtttactatgcaggctatgggatcttttttctcattggcattcatttctcttccagccctgagtgcaagaagaccttcttaatttaaatgcctttatgttgatttattttaatattgttaattttttgtagtgatcctaataattccatggccaggcctttagaagtgttgcggccaatctcctcgtcgcctggtcgccggaaacgagcgtctgcaaaagaagtccacactgaccggaggtgactccggcggggatcctccgaaggtcgtcagagaggagactaggcaatagtagaaaagaatcaaggaactcagcgagagggagagagagagggtaagcccaagggtttcgaaagaacctcctctagcactgttgccttccctgttttataatagagcgcggcatggcaccgtcattaatggcgcagacaatgggagagttgtcaaatcgccggaggttgtcagagtcgttgtggggctgtcaaatcaccgtggggctgtcaaatcactagggttaacccatgtcttgggtgggacaatgtctcagggcggctgcgctgcatgcctttgtcagggcggcggccctcagcagccgtacggtgttcggaggagccgatcgaccatacgtcggcatttggtcgtaggatgtcgggtgaagacctagggacaccgtcggctggaacggcgcatcgtggggatcggacatcggccaccacccccgatggccaatcagatgtgttgccaaaatcgggggtcgggccgcgctattcggccagtcgggttcgggaagggtcttctcgaccgatatacctttggtcggacggtgtcggttggtgcggtcggtagagtcgggcgccggccagacgggcccaacggtgagtcggcgtgagagggaccggtcggtatatcccaacaagaaggttggcagtttcagtggataaactgtccaaagtagtagcagaagaagtacctggaaccttgtcttcattgaagatgtctggcttggagattaatgatttaatttgccaatttaacaatctaatgtaagcttctctgctcagtgtttcttgtccaaagtagtatcagaagaagtacctggatccttgtcttcattaaagatgtctggcttgcagattaacgatttaacttgccaatttaacaatctaaggtaagcttctccagtcagtgtttcctgtaattacttcaaagttcaaaatgtatatctactcaatccagataacttttccctttcttcattatgttttgaaggcaaagaatatcaggaaaccaacatggaaagaaagttagaacaaataaatcgagcttgtgggggaagaagtaatccaataataaactgatctccctcctagattcaagtgtattggagtttgcaaatactctaggtctaaagctgaaattgtgatcaggacacagagtcagtatacatttcaatctgatttcacagattccatgaacacattttgtgttctggaatatggattaatatcagtcaggtttcatctgtagattaaatgactggaatactgatatgttttctttttttttgggtacaagaatactgatatgttctctgggcccctttttttctaaaaacaggaagaagatagttcaacctgttatattttggaaatatacttaaaatatctggcaaatttgtgacacattgtggtataccatgtttctatattatttaatttcatttcaatactggcaggaagagaagaagactgttagttgtctttgatgggaagtgtggtaacatgtaaagggtttcgttggctttgaaacatatcagaggtacagaagtttgcaaatgcagtgtcagaaattgtttacaacttgaaaataaggaaatcaactatgagaaatccattcttgaggcggctatggtaaaactatgcttttcgattgattcaatttaagatttttttgacataagcatgtgacaacaccatagcatagctgacttggttcaaacctgatcatgaattgcaccagacaaatactggtcttcttatacttgaatctgacagtgacatcaatgggcttttgtgatatagcatcatgagaaaattaatccagcaattgataactttcatttgcttactattatttcttggacaactcttagtgatattgccagaagaatgtggttaagtaaaaccacatatttggtatagactcttgaagttgagcttggttcatgtttcatctacgtttatattaatggaattgtttagtttgctttcattcaaggctttgtctctgctatttgtcttaggaaaattatgtgctaaaagttaacattgttttattcatggaacctttagaatttttcttcctagttcttttcttttgatagcatattctctttaccttgaccatgatatggaaaaaaaaacaacatgagtaatatttgggaattaaagtgtgtccgagcaagcaaaagttggattgaatttcaaattcttgtagaaagtagtaacattagagctagtccataatgggaaggctcaacgaataaggattgatagaactaacccctaatatttaggaccaaggttttaaaacctttttcagtttcagtcatttgggtagtgtttcaatttcagccgtttcaacggttttaatagttatcttcaagtttttgagtttcgggaaaacagccgataaaatttacaaaataagagaaaaataaaataaattaatacaaatttgtggcttttggaggactaaagaggacaggaatccacggtttttgtgagattcttttgatgcaataaatgtgatgaggaaaaggaagaaaggtgaggcattggaactctatttcagaagtaaatgaatatatagagttgaaccatgcagtggagtcaaaatgggaaattttaagttataatagtaagatgtttgtaacaagtgctgatctgtcatagtttggagaacattcatgatgcaagtatatgtttcatagcttggcatacttctttacagtctcttcatagctcttcatgttctctgatgcttgttgattacatattagagtaaccctagatgttgacagaagtgcttttctccctgtggttgaaggatcactctttcggatctgcacctcccatacctatccaaaattaattgtcatgttaacatagcatcatttaacatagactaatcaacagaaataaaagtttaggattgtcttgataaaaatcaggctgatttgataattttcttcttgcaaacaatcaaagttttaaatgccatggaatgggatgcttcgtgtattgatacttgagatggtggatatcccatcccatcctaagaccttttcccaactcattctgtcccgacatttgggatggtgcaccatatagacagttggtatttaaatccttgcgaacaatcaaaatatgatttctttttttatgttttacatcttgtggtgattgaagcaaaactcataatgaaactaataacatgacactcaaagagctgcgattcaataactgtagatctcttcactcatcaaactgttgaaaacaatcttgtatgttcaaaaacaatatctttcttgttaatgaccttctagtcgagcaagttggaaataccatgttcttctgtggtataacattttcttgtagcaacgccatctacttaagaagaactaagatgcgtagaatgtgggtggaagacatgagcaagattaaatcagaaattgtctggccatttttttactataagaatataagccggcaactttttgagtaaggtgctcatgtcgagaataaggtgctgcatctcgcacatgagtttgcagatgatattctcattttgctggaaatgacatcaactatatgtagacacttcccttcaccattatgagatggtcttgtagctgaaggccaacttcataacagctttgtgatgaggtgaaaaatttagtggagacaacattaaggtgttgcttaagttgtttggtgcactgctctttaaatatttagatctccgttttggtgttgacccaaggttttctgtaaacaagagcaggaggtaaaaactattgtaaactatgtatattgagaatgagatggtgctctctatcataaacaatgtggtgctctctatcgtaaacaatgtatgccgagaatgagttggtgcttcttgggctgcagactgagatgataagagcaacccactttaagtcaccaaatttcttgtttcttttctaatctggcaatgaaaatcctagataacatagtaaatatgcaattaaacatcttttgggaagtggttagtgggaattccaaggtttgcatgagatttaacactagctaggtatggtggaccttgtccttggcaatttgaaagctagtaatctgagtcttttctttacaaatgttgtttacatactggagatgtagcaccatcttctatgtcaacaacaaatgttacgaaggaatcgagaagataatgttaaagaaggtgaaagcttttgcagttggtggagagggttttaatggaggttgaggattttaattggtaaggtgaaaaagttaaattatgagatgagcttgggcaggttatctgattctagaaagtatttccttatgaagagtcaccagatcttctgatatccttgtgattgaggcaaaagaagactcaggcaagaagtggattggactactttcttcaagaagagaccatctgaggtggctattagctagattttgagaactgttcaaatcaccttgtctgacctacttaatgacatagtcattagatgatttctatatgagtcccatccttcaaattctcttcaaagatttttctgtgatatttaaagtattacaagacatctttaacataacccttgaatctttccttctttgcttggagtagatgctctcgcttaaaagttggttcctttttttttttggatgagagaatgaaattccattcaattatgtatcaaatgacataaaatttataattcttgctggcttactgtggtaaagagaatgcctgcactgactaatctgacaaaagtgcccaagagtgatctctctctacatgctatctgttgagaatacaatgagtcagctaattttcttgcgcactgtgaagcaaaagtgttttcttatgacatgagtaaataggaaaaggagtcccttcatggaattgatggatattgttttggttgtcttaatacttctgtggttcgtttgttatgtagatttgtcatgatgggcatttaatttttaaaaacttatgagaaaagaagtgttctaacttataagagagtgagagggagaggtgtttcatttcaaacaaaggcctgttggcagagaactttgttgagagacgataacaatgtcatgtactctttcatgcacacctaaaataagccagatttgtcaatgttttcggaatgcaaaatgatttgcaaaccaagatgtaaatcgccatctttatacttcattattctgattatatttccttggaaatagtgcttcaagatcaggtgtgtgatctgcctagcattcttctgtcgttcatgctacatgaggatgagttaaatttctttgcctggaaggcatttgattcacaagattgtaataatatggagattacactcatgatgacagaaactaaaggtgttgattttctggttgataacgtcaccaatggatgattcatgattccaaattctcaacacatgaaactacaaaaaaaaaggaagtacaagtttgaattctgcgagaaaagaagaaaatcctgagctattatctaaaatttaggatgataatcaccatcaatcccaacattaggacaagaaaagattttaggaattaagaggagggtcaagcacagttgagataatgtgaatccagatgaacaatggtctcttagtgtgcctttactctttcattttcctcttgctggctctagatagacatctcatgacatttttgtagaacaaacacataatgatggtatgttgtgcatggttgttgggtttgggttgcgttggtaaaagggaagaccgggtagagcatctcatgtcttgagggttccatggcaacctcccataatgccatgagttcctctgctgcagtgaggtgggttgggggttctggtgatgataggtataatttccgagcaacctgggtgcattgttttagtttgaatgatggattcgcaggtggcctgctctgcatccaatttgggagtcagattctaccttcaattgtgatgatcttgtccttctccaaaataaaaagaaattaaaattgcaaatatgactgttaactgtcttttttctaaaaaaaaaaaaaaaaaaaaaaattcttgccagacttttgatttactaaccctgaagttggactatggggtaggaattttcttccaagacatggctagatttgttttcctacttcatgctggctaaagtggtttctggccgacctatttgtcttggttccttcctatccctgggtcagaattaagcagccggctttctggaattcaaaggcaggtgttgtttaggtggtgtctctatcttgtttttttttattatgagagaagtctgtcttcttcaatccagctataggggctaatgttttccaggcaatcaacgtgccttgcccgccattgccattaccagtgccagctctcaaaaatcgatcctatccagaggccacctcatggatgacttcatgatccctcgatcacagaattatcctctcatgtgacttttgaatcagagaaaggtaagacaaggaggactattttttttttcctttctttctttctgatagaagacaaggactacttggactattggatttgaactcaattgccttcattcaaagcagagcttgtttgtttacctggatggttttgcccgcctggatgggactggcttctgcctctatttcttcgccgagcagagctggcttgagatggttggtggagagctgaaccccggcgactctccggaatccagaggccatgtaggctcccaagctggccaaggtttccgagatgagggccgacactcctccgttcagcacatcaaaaggctgacacgatcgatccacaaactcacttaggatacttcaattatgtatagaatgaaaccagagatagattattattatttttcatatgaacacaaccatcaagagctagcggcacagacagataggttccaaaggcaaaaagtagcggggaaagcaagacgtccaaaagctgagaggacggattatccagaagaattgtacctggcagcatgttttggtgaccttgagccttcccgtaaccttttttggcgagacgagctcgtacacgaaaccgatagcatggagagttcggtcgatggacgctgtcatcgtcgctggagacggagatgatgttccttcggggtctggattttgagccatcttctttgatggaagatgacatgctacatggcttctgtcggtgttcctttgttgatatggtttgggcttcaaagcagagctagcccccagctacctcttctcttctagctaccgcacacaaaaaattaaaataaaacaaccatgcccaagggcctacctaaaccattaaaaaagccagctaacgcatgcccacatggttgctggtgtgaagtccactggctgaccacgtctttccaacgtggtaactattggtgtcaccatgtgatgaatattgtgaggaaagaagcttggaattggattcgcgttcggatttcctgatttacggttacagctcaaacccaaccaaattgcttgacagccgttgggggagtctcggagagttgaatggaataatggtatgtggtgggggtgggaaggccaccttggctgttctcgatcaattttctacgcccttctctggagaaagaatctgtttctctttcccttgtctcttctttagatagtcggagattcttttcctgtctctttccttcggtgtttttctttttttnttttttttggagggaacctttaggtttggtatacctgcctccaaatgtaggcttagatggattaagtttgaaggcacttctacagtgggagtgcgaggacacaaattactgctctccctcgagcaagaagcccaaattcagagctaagcaaagagtataatattgaagttgtaacatcgacttcatccggtccccaataaagcttgggtcccagtgatgcactcggatggcaattctgacataccagcaaggttagacatcaagtgggagactgattggccaagggcccatgaccggatgcagatatcaacgaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttattttttttgcatagaatggatcatagccggaggaagatgctcatatttttgtgctcaactcctgacactgcagttcttagggataaggttggcagtcattgataccggttttgttattgggaggaaaatcggaaggagctaaggaagttgcaccatagctcgactaagactgtggaccacctgttttcagattgcttgttcttctctgcagtctagacagcaatttgcttcaagcttggggtgctataatcttatggatcttttgcagggcttcatttgaatcggataagatggaattttccaaaaatgggtaggctggtggtactaatgctcgttggatgttggaaagagaaaaaaagtagctaggcttaagtggcatttgaagcactacatctcttcaatctttagtccaacttatgcggtgggagctcaccagtggaacataaaaaaatttggcataaaattaaaataattcctgcatcaccctaagacccctgacccgctacccatttcctcttgtatgtaggccgtagagtcattaacctttagtcagattttgagagtagttttctttctaaaaattttgtatttggcttgtaattgctactgtaattctgaaaattacttgacagtgctataatttttgagtcggacctgcaacctcttttgatctataattttctctgtttttattttatgtatattctctgttattaataaaaactggatagcttccagcctcccatactcatcaaaaatattttccaccacctacgatgcgcctttcttaccagagacgcctatgatctatatgttgaagtccacgtatttggctataggaaagttcaatccgaagcaaagccaattattatgggagtgaaatttggatttcgcatgatttgctcttgagttcaacaagtgagattttacacaatcatgctggattgcaatgcactgccaacttttattagtcgacataagtgctgttcttgtttatagtttaggagcacggcgattaaggtacaaagtagtagaaggtagatttttttttaaatttaaatttattttattttattttttgtgtgcgtgtatgtgcagggaacaagttagattaaagttgataatcttttcatatgggaatctcgttcttgtaactttatcatggatgatttgttgaaaagattttgggtacttatatggaggtaagaaactcaaataatacctttcaactgattttttttagataaatttctgtattgttataaattttattagggctaatctagtctatgatccatgtggactattccacatattgatcataatatttatgaatggatctatataaatttgaaattttaaacacgaaaatatatgagaacacatgcgagcatgtattttatctcatattagttatttacttaaaaaatttaggattgttattcaagatcaaaaaatctgaataatatcttctgattagtttttttgaacgtggtattcaaataatattttctgattaatttttttgaatgaaattttggactatagatacccacaaaggttttttttgatgattttttttaattattaaaaagaaaaaaatatttttctatgcgtgtacgcttgctccttccaaccgcaaacaattgggatgtgaattcatcgtgcactaacttttgaccatcatatctcttccacggttaggctgagatgcacttcgatgactgaagtataattttacagatagcaagcagaccacacctaacactggaggaatatgtggctcctgttacctaaagaaaggactatgtacgttatgagttttgcttttaacgttttgttgagcagtaggactgcacttagggaactttaacataatcttttacgcactttcacaaagataatgtacattaatgctaaaaaatacgacaaagaccaaagagagaggttgcttgccctgtcttcctattcaaagtgcataccaaactatggcttgaactagtaatcattgctaggcaagaagggacttgcattcttcgccgggggtaaaggaagaaccttttgaagatccctgcttctaaccaattagagatcaactcacccgacaaggaaaagaagccacacaatcttttccgattacttctattctgtgcagaattttcttccttccaaggaaaacaccagtctaagagagaatagtttgccttaccaaaagactaattttttaatgaagaaagttaatattttatgttttatctaatgattatttcatgcatgatctttataacaatccaggacatcacttaaaaaaacaagccagaagatattatttcgatttattggctctatataagcatctaaaattttctagtacatggccaatataaaactaaacatacgtccgcaggattcttcacatcctcatctcgtttaggtcctgacgttcacatcaagctaaggatccaaatttattcaaatcaactaaaagtatcataaattccatgacaaatatcacgattaggttgtggtcatcccaaattagcccgtgttatagtatccctagtccatatatgctatatgttaaatcctctctgatatcatttcaaacaacctaagatctcattgaaaaagattggttgaaaagtattatttggattcctgatccttgtataagcatctgaaatttatccagtgcatcgttagtagctgatatggagctaaatatattcatgtatgggtcttctgttggctatgtgctagcatgcactcagtaggatccaagaggggttaccaaccaggaggtggctaatgacgtggcaacatcgttggggggttaatttgtccctcatagataggaattaaatgggattgattgcccagtctatcgcttgaggttgatctgatttgatacagatcgactcaagtgcgaagccccttgagcctgtccgcaacacatatagatgtaaggtttcattcctatggataaaggctaataaatgttgccttctatttgacaattaccttttagaagagtggccggggctgcggtcctaacatcttcatagtcctcctaggaatgaagaaaagtttgttacatggacatgtaaaatgtattgatgtattgcaagattgattgccaatgtggacaatttgctgtgctttagcggcatcttggttcattgatccaagtgaccctccctcttagtctttgtcttgttcaaatgatacaaagcaagctccatactgtgtcagtaaatgagaagatctattggtaaaagcatctgcagttttagtaaaacctcacattgtaggaggaaaaaacaaagaaatatgcataacaaaagggattcacaaattgtattgaagattaattaatgtggaaaattgtattgcagatttatttatgtggggatatagaaaagcttgaagaacctatttgaaccagattctgattagctcaattgtgttatctgaccacgaagctttagaactctagaacttttgaacaagacccaagagtgcgcctacatgagagcaaccgcaaatacacgcagcccaaagtttttccttcaccagagttaaacattaaaggccacataaataggctgattgctgactttaagaatcatccaaattttgggttgtatatgcttcaccatacctatctaaaagaccagatggaagtcaatgtcgtcaatgggactaatatcgtagtcatgaaatgtacgtgagaagaccagaccaaccatgctggtcagagtcaaaaaaatgggatgcactagttaaccggacacctttaatggccttacgtgtgtctccatggtcagtcatctaatttggagcgtgaatcccctgcagtgcatcgtgttcaccattctctctgcgatggatggacggccagcaaacaatatatggcatatattgtttgttggctgtccattgtacgatggacggccagtatgatgcaccgtcagaggagtctctaatttttcaccctttggaatgttggcgtaccaatggtctgaaatatttcagctttccttccctcgttcttagaccaaggggcgtgcagattctctaatttttcaccctctggaatcttcgcgtacggtatgatgcaccgtcagaggagtctctaatttttcaccctttggaatgttggtgaaatattcccttgttcttagaccaaggggagggcttctgctataaatgctgggttacttcttgaccctcttacgagcaaatagatgtccttgtgtggtcttaaaggctgagtagtgttagaaagagagagagtagcaaggaagcgagagatgggaagagggaagaaatgtttgctcggctttcttggcttcaagaagaagagctatcggagacaagatgttgaagatggagcgaggcatccaagaaaggttcgaccgagcgacgaggaccagaaccattgctggtatgctgatccaaatatagacaggaaggctaaagagttcatcgacaaagttcatcgcagcatggaccctgacgcatagtccattttcccatcgccagtagctcttccccgcattgttggtccacctatgccatgttttcattatgtaactcagtccaccactgcttatatatgctgctatgtcgttttataccatgaatgggtgttttcttgctggctattaattatcatgtttcgaagattatgcctaaatatatttttgccatatatggatctataatatataagtctattgagtgctatagaccatgtaagtgcaggtatttgataacgcgacatgatctctgtaattttccatgccatgtcttaaaagtctctgtacgtaggatgcttatgaaatttttttttttcttttgggtaagaatgtttatggttgttaggcttgtgcctttggctctttacgttgctcatagaactttgtattaatgcggtattgttctgtcacccatgaatgaaatcataaacagatggtaagaaaaggctggtgatgggagaaacttctgaaatggaatattgagcatcaatagaagagggtgcagctgaaaaataggaagtggtcatgacagtaatgacgaagttcatagtgatttaattgagcaaactagattgaaattgttacaacgacttgcagcactgtttcttctgtgagaggattgtaaagatgcctcaggacttacagatgccagcttcaacgttcaacaccgttctctctcttttctagttcaatttctttgtgctcttgtcaatttctcagactcttttgcttccactgaaggataagaggaaagaaaaaactcaagaaaataatgcggttgcttgatataatattccaataatataaaaaaaagatcctgaaagggaagcactcgaacccaggctgttggatttgtcagcctaactctaccatcgcactccaccaccacagccactaaatttttcagcttgcttttgggttgcaggcttctcattcggtcaatcccgtttaacatttttttaatggctaatcaactatcattaccttaacttagaggttaactgcccttgataggtgacgagaagccacaaggaaggatttaaggagtctaatatgacacaagggatgagacttgcttgatcatttttttcccccttctcccgcttgatcatccttcttttctcctgtgtgacatattgactttgcatcagcttttggattccttttcttgatctctttaccctgcaattctttggcccactcccatcgcatgttacctacaacacagaagggcagaggacatgttagtacgaaaagaaggctgtctttttctagcccatattccttccgtagattacttggagtgcactcacaaaccgccatcattaccataccaaactttttcaccccagaaaaattttttatacaccgcatctaataaaaaaaaaatacattcactccatgtcataatttttcttctacgaatcataaagaaaaaaaaatatttttctcattaaaaatttataaaatttttaaataaaaaaatatctcttctttttttctgacatcctatgaaaaaattatgatattttatacagaaaattataatttgagcgtaggatgtcataatatgatcataaaatatcataattttttcagaagaagaagaatatttttatcattcaaaattttaaatgaaaaaataaaattgacgacattaaatacatatcgaaaaacagtaactatatgacccaatcagatagagtggtatatttttcctacaccacatgcgttgtacaaagaatctctttcaccccaatatctaattaaatccctagtgggtctggcagactggaagtgattgctaggggagcgttatcttaaataaaaataaaagaaaaatatgtcttgaaggaggttagccacctttgaagtgataactaggggagccccttggtcacaaagtgattgatcttttctctaatctctaactatatattttcttatatttagttttctaagatatgaaaggagtcatttcattgtgccaatggcttagggcagacctgggcataaaatttcctagccgtgatagagggagaactctagcttggccttactaaacctctcttttttcttaattacttcatcattttctcaaaaacttagataataagtattgcttcatttccaccacctgatcatggtcaaaaaccagaaaatcttcaaaaaatttgaagttttcactcaacaagtctcccatctgttgaattcacaattaatttttcttctaaaatcaactggtatatatagtgcattctactatacaaaattatgattgttcatctaatgcattctgatacactctaagatgaatcttctatcgcggcattggtgatctagtggcagtttgatgcatgtctttgatagacgatgattgagcgatcacccaacctctactgcttaattttttataatcgtactagaggagtttcaaagccttctgtctgcaagacgacaagtgatttgcctgctcactgctccacttcttctgttaccaagtgagatccatgatctcaacaaccttagacatacgagccattatttcctgatatagttggagcacgtctccatgattactgctctctagtggacggcgcatgttcctgaagacgatagatacccgttcttgtctataaaactctactcttcgagaccctctaggtaagtgaacacttgctccgcatgcttggtcctagagacgaactccattcgaactagaatctgactcttccacagaactctgagttcttttcacttcgccttagatttctatactccatacagtatcctccatcttccattcttcacactcttatacagatcctccatatttcacactcgatatcatttttaagcaccatttaaaactcaaacttgttttatttgcttctgcgaaagactgacttagacatcagaaggtccaccgatgaagaatcatctaatgtgaggattttttttatttttgatgattttacaggatttagttcaaatgacagattgaggacccagcacaagcatccgacttggaagatgccaattgccgtcctgctgcggccgccactctctttggctccagctcagtcgcctgagctaggtgactcccgatggcaacacatcctttgtcgcgggcatgcatcgaaatgagaattgggagaatggttgatcaggtttggtttctttagaaatctttgacaacaaatgttggccgatatcatataaagaggagaatcatcagggtcctaagtggagtacaacttgtacatcgtttttggttaaatccaccaacagcggcggtccttccaattcaaatgagagatcactggtgtccctccaaaagagaagaaaattcaatagagatttcagattcaaacctcagataaggctggcatccatttcccgtacagattggaaaaatgaggtattgatgtacggcttgctgggaatctttcgatgtgagaagaacatatcacgtggatgagtccatctacttcgaggaacataaactaattgcaatcattggaagataaataatcatccacgctacaataagaccagggaatcatccatcaataattcaatattgttttgaccaagataatacttatctactcattgagtaaatgtcatcctaagtccgcaaacactcggaggatccaggaacctgtttaaattaatggttaattatcagatgctgtatctctataaataatatataccatgcaatgaatcttgcttagatccaagtaaggcatttagatttcttaaggtacgcttgggtttgtcaccaatccaaaaacacaaccatgctataatcccgaacattatcgagggtgttccatatttatctccaagtcagaagaagttactagtattagctcaagttttgaggaaacatttattagtaaaagttcatgttaaaattttctttttacttcttaatctcccattggcaagattgattcctacctatgaattaatatccaattgcaagcacatggagactttaaaagtgtgctagatgcaaaggtcttccgaaattagggggacatttcacgtgttggatgccaatttggagaataatgtgatccatgtgccccctggtatgttcagaatgcatgtacagggcctcatctcacggatcttgcctcctctttgcctaaactcataccccaccctcaccacctccacgtccttcccctatatatacagacagagggaggtattagattcattccatcctcctgagataattgagctcatgggttcttgggttcgcaccatcacctctcccttcagaaaagcttgcactctcttcagcccacccagggacaagaagtctcagacaactggtttgtctcttcatggctgtgtgtcatggacttgcaaaaactatatacgtacgtaggtgtgacctctttgcaacttgttgcaggatatgatcaccatggcttgaagcttcatggggaggtgatggcctgttcgtatgaggatgtccgagtgatgtggtccatcctggacaaatcaaggcccagaaaccacgactcacgctcttgaggcggttacaatggtcgcccagatgagtatatatgcagaaagaagaacacagtaccagggcatgcaaatgcatctttacacaagagcgcataggtatgtaaatcgatcatagtttgatcggaaaggagaggtatgaaggagaagctggaaatttgtcttctttattagtttcagggagatgacaactccttgtaattgtactttgccatgttgctttaattgaatccccatggaacttgttaaatttgaaatttccatggtgagatttggtaaacttttggtttgtatgatgtacatgtgcttttagtaaaaaacgcattactaattgattccccccctcaaaaagaaagaagcgttaagcattacagtttgaaatgaaaatggtcaaaatgattgtggattgtttcttcctctctttcctataaataaacaaaaagaaggaaaaagagggaggagtatatctataccagcttaaataaaaacattgttgtataattctcggttccgttttgtgaaggagagacaccaagctatggcaatactacaaattagaattgatcacttaagtaggatcggacgagctttcagttaacagtagggctaaatgctagcatatcactcttacaaaatcttgtcatattatgcatcccaatcaatacgcacctggtacatctgacatgcaaacttacaatgattcatgtatcatttttctttcccgttttctttgtgaagttacatgatgttttgctttagtgcattatgtctaaacccaacgaattatgtggatgtagagagtataaacatgcgactcggtgcaactcatttagtttggagctgaatctgagctgttcatgaacaactcatattcagggccctttttctgaatttggttacaattaagatctatttggacgcctgcatgtatcatccatcagataaacaccaaaatgaattgaattcagatgaaacacagcagtaggaaagaagaatacgatcgatgcaattaaggaagctctctgatcatctaatctacaaaaagagggacgtgatcagattccatgtagaggtgatttccggcattccatgacttctgggattctataatcaacagagtttcctcaataagaaggaatcattcattttttcctctaacttctcgccataacctataaaaagtatacatacatacatacacacatacatacatatatggatgtatgcatatatgcgtgcatgtgtgttcacacgtgcatgtgcatggcatgtctatatatacatgcacatataaatatatgcatagcatgcatatagtttttttatattcatgtcccacaaaatggacaagcccgtacatgtatgtaaagatgcatggaattacaagtcccttagctgtgcattgcaactttctttccaatcttgctctacagagttaataaacttaagtggatccttggcttatatgtgtcgtgtgtcctctccctcttttggtctggatacgttatacatgataagatatcccttaccatgtcccatgcatattctcctcccattctacttctacaatttttttaataacctctgattgctaacaagagggatgtgattgggggcaagacgtagcacacaatatccttttactattattgcaatattgtgaatatatttatttctttgacttgactcgcacatcagtacaatcatgccatctatagattgttccccctaacaatcatccatggaatgctagttgtccgagttaatattgttcggcacatattatcttaattgtaacccaattagcaatcatatagtacacaactaccaatattcatttacatctgatcaattgttaaatttcagtgtatcaatcgatttttcatatgttctaaatttatctacccatgaatattggaagctcttagtcttggaatatctcttcatcccctggattaattgtaacataatagcagataataattaacattttctacccattaagtagaaaaaatacatattgatccggctaataatgacgtacaatctaaatgcatgaaacatttgtttatgtcgaacatgtaggttcttccttctgacaactaatcggttcaatgcttgccattttagttaccgaaaaacacagatatatgtgttcggatgcggctgtatctctttacaaggacgtggtcgataagaatacgtttcattcgcattgatataaacaaaattttcgtttgtaattggtaagaatcaattaatattaatgtttctttacccaaagaaatagttaagattaatgcttctttaccaagaaattagttaagattgtggaatgtttgccttgtgatgctagcataacccggcgtaaaagatcgaaggaccagttttttttggtaatattagtcatagtttcttgatttttggatctaaacgaagagattttccagccagctcataggagaaattttagaaggaaattaaccaccctctagttccttggagaaaacctttcgaggtttagagcacctctttgttgaaaagaggacatccaagaattacgtactggtagatccttctctatgatcacttcgatttaacataaaaattaaaaggagtactgcgtagagatcgatggagacatctagccagctagcgaatcactgctatagtgagaagaaaccatttcacgatttcttaatttatatattgctccgcaagggatcgaagagacggggaagaagatgaccaacatacagagcctaaccacaaaagcaaccatgcacatatatataggacaagtcaagctagctagctacaattattcattaaaagcaaaggacttggagtaggtgaaaaagaaagcagcagcagcagcagctagtagtagtcgtctggatgttcagttcaaagggaagtagcaggggtcaagccatgggttgttggtatggtccatgtagggctgcaccatctcctctccaccaccaaacatcaagttgtcattggggttcatcacctccatgagccagttctgcctctggagcgcctccatggccgcctccagcggcgtcttctccttcatcaccgccatcggtgccggtgcctcgatcggcgcctccagcaccacctgctggctgctggacgccatctgtgccctcaccagccccatcctctcctgcaccgccttcaccttcatctccaccatccacgccaggctggtcgcatcctcgatgcggaggctgtgcaggctcctccccgccaggccttggtacatgagcagcatcgtctccaactcccggttctcgcgctcctgcttccgcagctgctcctgctgcttggcgacgcgctggcggaggaatccttcctggttcatcatcttcttgcactgctccatctccggcatgctcttgaaccgcgccagcaccctcgtcacctccggcaccgacggccacacctccggctgcggctcctgagggccgtacacgatcacgcacgccttcacgtcgcacagcgtcgccagctcgctcaccttcttcatcaaccccttcctcctcttcttgaacgtcgccctcctcgtcgagtcgttggcgatccatgccaggttcaccttcttccttgccatggcgtgggaatattgggagggtaatattcatctggatggtatttatagaacaaagaaaagcgggatcgatacgaagagtaatggcagggattcggtgtaattcagattttttgattggaggattgatgggcttatcgaggtaacaaatcattgggaggatttggaggtattattatcataaagatcggctttaaccgtgtgggatcacaggacagcccgtgatcccccaatttaatccgacataattaagaaggtttaagactgattagatatgcatcttacagccaataatcaactcataatctcttaaatgatataattaagtgggttcgacacttgatgcgatgtgtatcttgcctttaattgaggcatgcatcttccgaatcccgagtcttggaagaatcccgtcttcctagtccgttagggtacgtacgtacgtacgtccaaaagaagctggtgctggaaaatttagaatgtaatttttcagaatccttcctattcctatttgatctcgcataccatatttttgcttctgctgattgatggtcaaatttgctaaaaattaaatgaccaattaaacttaactactgtcgaaaaagattggagaatcaaagattagtcgcaagaagctagaatgaaatacctatgtcgcaaacaacaaattcattatttttctctcaaaaccaaacagattttttcataagatccgaagttgtgcatgttgatgttggcctgcctctatatccatccacctgtcttaattgcaatgctcctagctgccatgagtgctgtaggattaaatttaattagtgcaggccaccttagaatcttactgccattgcatcagaactacttaattgaatttttaatttgaagaggctaaggtgatacacgatttcacatttttaggatggagtttgaatttttccctggtaggagcttcaattagaaatatctagtccacattagttatacctattatgcatggatttctgaaaaataggaacaattattcgatgaactaggtcgagtacaccaaccggtctatatctcgaggcacatgtacggtaaaattaaagatcaaacaaaggtcagaattcatcctattatccaccacatacctttcttgatcgagatttggatggttcactggattcgatccatttaataatttaccaaaatgtagagattattggataagaccatggtgtacatgccatcatctaataatttttcctttctctttacttttttctaattttcttcttattccttttatatccattttattttaatgaaatgtgtaatgatcttttatgatattttatgttgagaaaactcatccaagtagctggatggaattaaggtatgcaggttggtcgagtgaaaaagcaaatcaaaaccccacccctaccttgtgcttcgttgatacatcatccaagctctaaccaaccgtaggtcgaaacccttcatgacgtggtcaacctgatgtttagattccctgacgatcacgccaaaaatggtgcactgtgtcaatatgtctgcaagctagatcgatcatcgtcgatctcttatatatttggctgaccatatgacatgcatgatcatcaccagtaacatttcaattagcaactatctgcaaatcattcaactacttcatcttctaaatgatccagatgtccgagatttccatattatccatccaaggacatttcattttcacttttggtttacaaccttatgccattaatcgtagcagcaatgcggactcatggtccgttttatcaaataagacgcatgttcaaggttgtgttttgagcacggtttgagcttgacttactaactgatcgaagatggtatgttgttgcgtgtccaacaatctggtcgaatttcaatggatagtttgcttccaaatatagtaaagacacgtcctataacatcttgcacacgattaatctagcttttaaatgataaattgtatcacaaggttcttagctagctcttatatcaaagagatcatgcataaataaagtaagatccggaatatttatcttcaaagatccagctaatcagttattatatttccatgttttggatcccatcaactccaggttacaaaagagtaatgattggacagctcctatttgccaaggcaagatatgagtaacgaagtaactaggagtcatatctttctgtagttaacctccaagggctttgtgcaatattcctttcaaagagaacgatatgcatcatattactttggtcatcaattgttatactcagtttgtacctacaaataaagctaaaacaatcaatactgcaggctgagacatgatacaatcatgcaagtttaacaattctgtttgcatagataatttgctgcattctaattttctagggttgaaaccattagattggttgggaagcttggaaactatgagggaagagaaatagaatagactagggagaatgtcatgaagcttggaactaagagagagagagaggagaccgtagaggatagaaaatggagaggaggaagagagggaatagaaaagctccatctatagtaaagcttccacggatcaaattatgcatgcttgttaggaaatacactttaaaatttggtccacattgagcccacagcaaggtataggatgaaaaatggagtccaacgagcccaagatcagcccaattaaagttcgaacgaaaaagatgcacacgagagaaaatggtacgaaatctggagcgacgacggccggcggggtgccgcccggcccggtggagacgcgcccaatgcgtggatatgcccagcgtgggtgcgcacggcctaggcgcggaccgcccagtgcgggcgagtgcgcgggccggcctagtgtgcacaagcaggctagcccagcacgcacaggcgctcggcccagcgctcgcacggtccaccatggactgcggggcactggcggtctgcaggagccgcgtggaccgaagtcacggtccatacgtagttcatgtggatttttacgcgatcgaacggtccaaaatgtagtcgattgcgatcaaacggctatgagcgaattcgagcgtgattaggtgataggggggctattttgtgcgatcggatggctcttgtgcgagctgatcatgatcagacggccacggatgattccaggtttgattgagattttgtttcctactgaaacaatatttttgtgattctggagtgtatataactccgattgacaaaccgtttattgcattgggaagctgatgacgtcctggaggtgcagaaaggcttcaacagaggttttaaagagcttttgtgagagttttgggattttttcttgagagactcttgtacaacgattgagtggtaagttcctcttgtattgatcttattttattctctcatagtgaagcttgcacgccacatggaggtaggtttgagatcgatccacgtatttgtattgtgtttcttattttgtttcttctttcttcttgccgcatcgtatggtactggattctgatgggcgttacaattggtatcagagcaaggtggtgccagagtgtaggctgcagcggtgatgatcgagatagaagatggagaagacaagcacaatcaaattgaagatcaacaggtttgatggaaagagcaatttctctttgtggcaggcaaggatgaaagacgtgctcatccaacaaggattgatcgatgctttcttgtgtgatgagaagccaaccatcatggagatgcagaattggaggcggcaccagatacagacggtgagtactattcgcttgtacctagcggatgaggtggtgatccatgtgcttggcgagacttccccgacgaggctgtggtcgaagctcgaggagttgtacatggcaaagtctctcactaacaccttctttcgatggaggcagttttatcaactgcggatgattgagggatagagcgtgcaggagcatcttagcaactttcagaagatcttcaccgacctcctcaacgttggtgagaaagttgaggagaagaccagagcgctggtcttgctagtgtcgctccccccttcgtatgagtccttggtgactgttcttctagtgaggaagagcaccattaagatggacgaggtcactgtggtgattctccagaacgaggttctaaggagggagaacccagcttcaagctcaagtggtggcagctcagcattagtgatttttggaggagcaagaagcggcagacaggacgacaggagatcacggcgagggcggtccaagtccagaacgagggacttaagcaagaccagatgttatcggtgtgacgagttggggcatctagccagagattgctctcaacttagagatcggacaagtgctactgcagcgacggtcagtagcgattcagaggaagatattttgaagatatctgacgaggaatctacttctttccagcagtggattttagattcggcatgcacctatcatgtatgttgtagagaggagcagtttgactctgtagagagtagtgagagtactgtttatctaccgaatggatcgagctgtgcgatcagaggcatcgaatggtcagctggaggacacacgatggtgcagtgaagagattgggggaggtctgatacatatccgatttcaggtgaaatcttatctcactgagcatactagatttgagaggctacaggatgatagctggtagagaaattctgaaggtgttgagcagcgataggattgttctggaagggaacaagaagacgagaggactttactacctgacagggagtccagtacgaggtggagcttccggagtcaggaggagcccaaagtgaggtggagctctagatggaggtggatcggacacgagacgtaagactcgggaggatgagaggcgatgtcgcagggtgggattcctattaccatatgatgatactccgagcaggtctatggtcagagtggacacagtccatgatggaggtgggatcgagcagcctagcttgactcctacgtttgcctatccatgagatagcaggcatgccctagggtgtgggggtgagacagatcacaagctcttagagataggtgaaggccgaatatcgagtcgagatagagattgttaagaaatacacctcaagattcggtccacattgagcccacagcgaggttcaagatgaaaaatagagtccaacgagcccaagatcagtccagtcggaatctgaacgaagaagatacgcatgagagaagatagcacgaaattcgaagtgacggtgggctggcggagcgccgcttggcccgatggagacgtgcccagaacgcgtacgggcctagcacgggcaggcgcggcccaggcctaggtgggcccagtgcgggcgagcacacgggccggcccagctcgcgtgggtgcccagcccagtgctcgcgtggtccatcgtggaccgtggggcgctagcggtctacgggagttgcgtggatcgaagtcgcggtccatgtgtggttcaggtggatttttgcacgatcggacggctcagaacgtagctgatcacgatcagacggctatgggcaaatccgagcatgatcagatgatcagggagggtattttgcatgatcggacggctctgatgcgagccggtcacgatcggagagccacggatgatttcaagtttgattaggactctgtttcctactgaaacagtatttttgtgattttgaagtttatataactttgattgacgaaccatttattgtgttgagaagctggtgatgtcctggaggtacagaaagacttcaacaatggtttcagagagctttgtgtgagggttttgaaattttttttgaaaaactcttgtacaaggattgagtgatgagttcctcttgtattgatcttattttattctcttatagtgaagtttgcacgttccgtggaagtagacttgagatcaatctacgtatttatattatatatatatatatatatattttttttttttttcttcttgtaccatatgatatcggaaatcctgatgggcgctgcagctttaagatccaagcaactgaagtttcaagggaccgataagctgtggtctttttgctttttgttgctctgccatggagccatcggtgggaaagaaatttttggatctttttaaataagagatcctccccctccttaatttattgtacttaaagctctacatctctgcaataattggttgatcctttgttcttagaaggagcttcctcgtttctctaagttgtggcacaatatcaaggacttctaggtgctagtataatctgttgttgatctttatttgctgatgttgttgttataaaatattgatgtttttggatatgatgaggccgagaaaggtattgtctagactttgatccgttttcacgatggacatgatgatctaactctctttctaatctagagtgtttttttttagctgatggtcactttcttagttaatggtcactttctcctgagcaagatctgagcctaattttgtttttctaatggattgtattattgatagctgaaacttattggggtatatttggagcttcgtctatctttggctaccatatctgatggtccctccatcttttgtttcttctaatttcagagatgatgatgaagaatctttgcatcaatgtgtggactttgtggtccaatttggctacaaatggcaatagcgatctcttttgattgctgtttggtctccttcttaataattcatctgtgtcttatttttacggttttcattttggtttttttcttttaggcatgctccttgtcttttaatggtgctcatagctctcgtaacttgtaaattcctcttatatgttcatatgcaaataaacctggtgactaatgattttatatcattagtctccatcttttacaaaaaaaaaaaggagaggggatagtgagtaatttataaaattttgatgcatctatggcaaataaaatttttgccatccagtcgtaacgaatattcttagaccttggactgctttttaatctctatagggtacagtactaaagataacatctgactactatgatgaagactctcccattccaactccacctatttgaaccttactatgtcatcttttgtttgaattctaagcccttccggttattggggatccatcttgatagattctactatttcaatgcctttttgggatgctagagatctttctcggtacaagaaacgccctcgcgcttcgttttccccatattttggtctctctcaaatcatgttttcaaacacatgcacagtactacttaggtagcaatgttgatgaagggcaattgtagcaattaaataatattaccgaaatcatgtcgtatataagtgcagctataggtgtcccggagctgcaataagaacacggaaggacggtaaatagcccagccaggtaacccaccaggtaaaatcatgttgggagcgcatgtatctggatggtaaattgcttgggtttatttgggctgattgggctctcttactctccctcctctcgactttatttttaattttttttctctttcttcttgcccccatcaaataaaataagaagatatttggttcgcaattaaaatcgaaatcgaaatcggaataggaatgaattggaaccagaatcggaataatcaaatcatctaaaacgtttggatcgtgatcagaatcggaatcggaatggatgattttcattattgttgcttggttcatacaaagatagaaatcagagtcaactcaaatttttatttttttcttaactaaaatttataaaaattaattattttaaaaattgatattaaataaaaattaaacataataataatatctttaaattttttatttaaaaatatctatctagaaaatccttctacaaagcttcctcgaagctccctcccccaccactccgctcttcaaagaagaaaagccattcaatctctcacagcgatgcctctttcgcctccaccaccacctcctcatccgaagactctacatcctcccgccttcggtccaccccctgctccgtcctccccccttcggtcggcaagactccctccttcggattcgatgacctttggctcctctcccccatcttctcctccgtcttcgacctcttcgccgtcttcaaccgtgtcgatggcgatggcaagatcacaccgcacgagctgaaagccatcctccaccgtcttgacagtgtcgatctgtccatcgaggaggaggtagcgtcgatggtggtagaggtcgaccgcgatgacaacaggtgcatcagcttggaggacaaagggtgtatgcttgaggattgtcgtaggtaagtgagagttggatggataatttttttttttatctcattccattgaaataagattttgattttattagggtgagtccggattcaattatgaaaaaaatgaattattttcattcttctctgaaatgagaatcgaaatgaaacttcttccaatcaaacagttagaatagagatcattcatttcgacttttattctaaatcttaattactccaatcaaatactcctcaagcggtggttttttttattatattttttgaagaaaaaacgaaaatataagatgcgttggaccccagtggggcttaaaatgtatatttatgtgcgactatagagtgcagggtccggtaaacaaagctaaccaaaagccaacctagtacttccttgatacatcgtgcaaggtgaccgcggaccaaaacacatcaccacttggccaatttgactcctttgttaggtcgtgcaaacatatataaaaatatttggtgtccacgagagccacacaaagatggtgcgctgtgttgacatttgcactacagaatgcgacatgcccactcgctagctagctacaaaggtcgccctttccgagcttttggctgagggagaagagagctagggtcagcacctcataccatttgacatggtcatcaccagtatacctttctcagccttttggctcagatcaagtgcggacatggtcatcaccgataacatcttatttaccaactataatcaaatcaattgtccgttaccattaaatactgctgccggcaagcacagtgaccagagtcattcaactggggcatcttctaaatgaccaagatgatccggagctttcatctttcatgtttggcgtggtaaacgtaccttaagctatcaattatatataagagctaagtcaatgcaagctcggttcaaccaaatcagaagcatttttcaagatttgcccacgcttgcgttgggcttcgagcgagaattgagctcaactcactttctaataaaaaagggatgtaattggatgtccaacgatctagttgaacttccaatcgaaagtttgcttcctaatgtagtaaagatacatcctcaagcatcttaagcatcattaatttcggcttttaaatgataaattgtatcccaaggttcttagctcttatatttcaaagatatgaataaataaataaataaataaataaaaaagcagatccgttattgaaggctactataataatacaagaatgaattgccattatgtgattattgtcaaacaaccgaggcaaattaattagctcaaggttcgtgcactccacgttcgatgtgcgtttgctccaactacgccgggattttcctgtcgccttctggaatcccgttttccatgcatgagcccttctaggtagtgggatcggcactcagagcccaacttgatctgggctctttgaaaaagtcaacgcgtacatcatggtcaaagtcgaccacccattttgggtgtttacttccaacgccctttggtcatttccatcttttcttcagcacgcctaaaattgatgcaacaaaaactatgataaaatattgcgcaagagagagttatatatacatccctctcatgaagaagccatttatcccttcaaagccatggcttctactattattagcagctctagctctcctcctcttatcttatccttactcctcttcttctcttcttccaatattcttccctttatttcctatgccgaggctcgccacgttccttatgctccccatatcttatcaatcgtctccaaggagctcttcaactctatatttctccacaaagatgatagtgcctgccctgctaaagggttctacacctactcctcttttgttcaagcaaccaaatgcttcccaaggtttggtaacactggggacttagctacccgaaagcgcgaggttgctgcatttctcgctcagatctcccacgagacaacaggtatatacatcaaccttggattcatacatacatgcatgcatgcatgtgtacttgtatacatatatatatataagcttctagcttcatccatgggaacaagtggatatatatgatgatctaattcattgtgtgggtaatttgcgtccctattaggagggtgggcaacggcaccggatggtccttatgcttggggtctatgcttcaaggaagaggtgagcccacagagcaactactgcgactccacgaacaagcaatggccttgctatcctggcgagtcctacaagggaagaggacccatccaactctcatggtaagataaattgacctcccgaaaaaagtttgccattgagaactcatttatctgaactaagtagttgaaacccacacctatagaccaactgatgaagggtagtttccacagcttgtgacactcttgacactggttggatttgatatgctctaattgtatagctcaaaacaatggaccctggcaggaactacaactatgggccagctggacgggccttgggatttgatggtctgaaaaatccggagatcgtagcaaataactcggtgatcgcattcaagacggcgttatggttctggatgacggaacagaagccgaagccgtcgtgccacgacgtgatggtgggccgttaccggcccacggaggcggacctggaggcgaaccggaccgccgggttcgggctggtgacgaacataataaatggtgggctggagtgcggaattccggacgacagccgggtcaacgaccggatcggcttctacaggagatacgcccagttgctagacgtggatgtggggtccaatttggattgtgccaatcaaaagcccttctagctggttatcggaatttttggtcctttttgtctttgacccttagattaataatactgcatggtttagggcttgatcagcaaataaaaagatcaaaagccgatatttgttatcgataattctaatgaatttagaaaaaaaaaaaagttagatggtgaaaatcttaggtgatgtaagggatgtaaggcttgaactatgtcataattctgcaattcctatggccttggtttacgtatttatctacttttctggtagacgagctgcatatttgacctcttaaattagccgttcgatggttggctgaggctggagttgctgtgcctgctagaggttccagattgtaaaatttaatgccatctaattaaaccttttgaaaccgcattgatgaatggtggaacaaggctcagcctccgcccgtgtattgcatgatggcggtgaattgcataagaaagaacagtacgtacggtacagcacaggttgccatctgatctattcggtgggcccgacggagaacactatgggcgacttcgtgcgaagaggaggtagcttggaaaagcagcgcagaccgacgcaagggagggagccttcgtgcgttctcctgctcgcacgattagattctttccgtgcgctttgttatgtaaggatacaattgtaattctatgattttgtcgcgagtattttggatgaaaggtaaaattttataaagcccaaaaaaaaaaagcttcacgatctctctctctctctctttcttttttttcttttttttttcctaagagaagctccgtgggcccttttagctgcttagtacggagctaaaacaacttccttatttttttcccaaaacatactaaaatcatccaaaatacttttgaaagacaaaaaatacttcctctctctccaaacactttactaaatataactcaaaagactaataatcctcgattcatacgaggatcccagctcctataagccccttgttcccagagaaggtgaaatctaatactaactagggttttatgtatcaatatattctgccagtaaaatatccaaaaaaaatattttatttttaaaatcagataattcttcaagctctatattattccaccaccctctaagagccctaattgatcaagtccaaaatcttttatttaagtttcagaatgattgatcgatatgaaagttttcttttcgaaaaagagtttattcaaatgtatgttccaattatttgaaaaatattagactggtcggttgtagataagattgtctctttcatcttgtacattcttataacctttttttctaataaaagttgggtggtagttctccactgcttcccttttaatcaaaaaaaaaaaaaaaggaagttgagatttacctcctttgagattttagctctttcaatactactatttcccatggttatatctatttcaaaaaaattatattatcttttaacgaaaaaaaaatccaattcaaattatacaagaatgtacctcaatagtataaatagagacaatgtaagccaatttgttaacttatgaatgaaaaaaaaaaagaatgtagatctacttttgtcctttttttttatttttctaaatttctttaaaaattttgagttgactcgattgcaagatttgcttttcctcgactagatcatccagcaaaatgactctctttctgtgaactatgcaaagtttgtcatgcttctcgcaacctcctaaattcctgaatgcttctctatccatgcatatggggcttcactattttatggtatctcctcaatccttgtcatgattgttttcctttcattgtttacttttggtatgttgtttttcacaatgcttcttaaatcatccaaaccattcttcagaagaacataatctaagtaaattgtcctttaaatatcgaggctaactacctttcttcttatttcactttaaaaataccatatcttggtagttagaatggtgccaatgagcccaaatttctcaatgattcatgcttttcacaaagacatcttccaccatgcctgtaggattcattgaaaatttgaaatttctatttcataaaagatttaaattttaagtggaaccttatctcctccttttagatatttcgaaagttttaaaatttttcttttttttttggttttttagttccacattgaatgtgtaaaagtaagttctcttcctttttatagaaggccttaaaatgagttacattgctttcaaatagagcctttttccgaacagagcctataaaaaggctctaggtctatggtcttgaataatcacatcacatgctaagttcaagatagagaaagctcttccctatgcttttctacttattcaccattgtcttcctttttttgcaatcttttctccttgaggagctggttctttatggatgtaggttgtatcttttacgcgaaaaaataattgatcttcttttatagtgcgaaacgttggattgcactttgattaagggagccagctttttctacaaatatagcattattctaatagcacacagtatccaatataccaataattctttttagataatttaaatctaagcaaatttggatagagtattggttgccataactattagcaaaattaatatgtttcctatgagaacgatctacattataataggattctagtaatggcgtcaacaaaacattggaggctgaccgaccatgtccatgaagagtagaatgaccatacatacaaggggcacatgatggtttcacgtgagggtatgcatacataattggtgaagcctttcacagaccaaagatgctcgagtacgtgcatgcgaggcaatctgaccaactcgcacgtggcacgtggacagttgacgtccctcgtttttaaatagttagcacatgttgacttatttatgttccaagtaacggtataatggcggttatatcggtcttcgcctacctcattatttcatatatatatatatatatatatatatattgtatgtatgtatgtatgtatgtaaatatatgataaggagagaaacacaacagcttttcatttaacattgattatgatagtccgttattttaacttcctcctttttgtcccaatagaatattatttttaatttttttactaaaaagtttgaaatgctatcattgacgtaaattatagtcagaaaaaattacagcgatattccttaaattttgacctatttacgtttgcactccaaaagaaaaagattttaaataaaccctaaaatttaaaaaagttgcaaagaggctcaatcaattgtctccaacttaacaacattaataaaaaagatgaaataactaaaataccctcaattcacactccacaatgatttttttgataacttttctctttgttcatttgaatactttttgagtcctcacggatgcccacctcttccccactctccttgctgccacctccgtcaatctgcgtcaccatcttcctcccaattgtcaccattatcgactttctcccaccaatctccctcaattgctttcatttccacagatcaccgaaaactaaagatgccgacctcctccttgctcttctcgccaccatcttccgtcagtctctactgtcgccttcctccccattgttattggtattggctttccccctctaatctccctcaaatatattccttcccatagatcttcgaaaaagagagacatcgacctcctccctgctcttttcgctgccatcgcccgctaatctccattgtcgtcttcctccccattgtcaccagcattggccttccactccgatgtccttcaggtgcatttctttccatagatctttgaaaaaaaaaaagaaagtagaaaaaaaagaggaaaaaaaaatgatcaatctatgtggaaaaaggtcatgccttttaacttttccaccattctttaatttttgttaatatttttatattttttgattttttttgattttttttattcttaaaaatctctatcaaaccacgtgttgagttttgatcatgctaaaatcaagaaacttctaaaaagaacatttatgttgcctaatggagatgggcggtggtatttttttataattttttttaaaatttcgagatctatttgatttttttcttaaaatttaaatataaatggatcaaaatttaagagtatcattataattttttataaatattataatgatgataggagttatggtgacggcccatcgtaatagataatgtgttatttaaaatcttgatttagtcttttcccaaaaaaaaaaattcttgatttagttttttatgttggtgcttgatcactccatgtcaccgaaaggcaaaagtatggtgcattatcagccatggtgtggtgagaggtgtaattgagcttgagcttatctgagcttgaatgtgatcaagctccacataactttttttttgacgcatgaagtttgtgaccaagattagctcatttatcatattattaagcttaatttggaattgaattaaagataaatctattttgataagtttgatagtcttcacttttttttttgagaagcaatagtcttaaactaagttgaaatcagcttgagcttataacaaactcgatgcaagctcactaaaacatgaattaccattcaggctcatcagttctatactcgattgttctttttaattttttcttaatggaaagatgaagggcagtcactacatttagtgtaacaattgattatatatgaacacataaagcattcatgctggaatatattaaaacatattttgagtcttatcctgcaaagcatgatctacttgggtttacttccaactttgcttgaagttcaagtctaaggttcaagcttggtttaaccatatatatttgatccaagtttgatagagcttattttgagccaagattaagctaagcttgagccactcatattaatcaattggtaattttatttaggtcagatgatgtgcatttcagccagagattttcaaaagcatgattgtggccatattgatgggcggctagttttgagataaaccattatcttggattatttttacttaaatagagagatgagtgttgatccaataattaattttgataaatataaaatatttgaatattttttttatactaatatattattgaagttcatattaagaatatttgaggaagctacagtcactcttagcaagtatttcatcaatgccaagttatagagtgtaaaaaaaagatggaagaagccacatcatgagaaatcaaatgaaaaaagtcaagagctgaccctaagtttcaaagagtcgaatctggcatataaatataaaatgacatagtttgaaagtcgatctctacttttgttgagtcgactctctcaaatagatagagagtaaaatttttcagtactagcatcgagtcgatccttagtctcaagtcgattcttttagaaaaaatagagaactatgtttttctgagcaaactttgagttgattcctacttttacagaattgactcgtagttagctcaaatcaatccttatttgatctcgagtcgactcgactgcggttaacaacttttatggctagttctgcataaatttcagaaatatacaaattgagtttaatggctagtttttgattttcaatagctaagaatggctttttgaatatatattttaaaagattgtaaaggctaccaaacaaggagaagagttaagaaaaagacaaaaacaaaaagaaaattccagtacattaagtgagtatttaaaaaagagtttcaaactttcaaccatcaaattcttaaagcattcaagtgattttgagtgcattgattgtcaagcttcttggatacaatcttcaagagcttcattatctttttaattggtttttttaggagcttttattgtattgttcattatatctaattctatattataaataagttttaattgggattgaaatatgaaagtaggcccatccaagccttgaattggagtatgcctattttgtgagtctagagttagcttgtggatatagttttggttgattctactaaaaaaatcaattgggtttgattgttagttaagaaaaataatcaagctataatctgaggaaaaatcataataaaatttttaaggatggtttgaggaataaatataggtgctaagtttgacgctgaatcactataaatttttttgtatttgcttgtgtcttattatttactttttatttctcattgattgcatttttatatttttgtttatcacatagctttcactcacatcgtttgaattagcttaattattgtatacaataagttttaatttttttaaaaaatctaatccattccgtcccttaggttgtttagctgggcaacagtaaaaataatggcaaagatcaaaaaatataaagcactaaattcttggcaacatcaatgtaacatttaaaggcattaggtcgaatgtttaataccatgtccctttttttttggtccattagtcaaatgatcttaaacagcttaggttctagacattgcattgctaatcttttttgtcacacacacacacacaatttgacccactttcacatagtaatgttgtcaacctcaaagtggaagcatttaagacgtaactgataaacagataccagattccacataaacaatatcgtgtgaccattggcttaatccaggaaaaaaatttctcatttgatttcttctggccatctaatcagtaatcaacgcatgctttcttttaccttaattttccttttatttcgggaaggagatggaagattgagtagtgggatataccacatctaagtactcggagaaacacattcaagtttcaaagaacttagaacttccttcgtttggaacaatttagcagccaatgtgctgtttcttgattcacacctataatcagcatgcaaaaggatcaatttgatcgcttgtatatatatatatatataaagcaacctcatgttttatatttttccccgtatacaaactaattggcagaatgatatgctataagatgatatacgatagactatcaaactactaaaatgcaaacttatatgcaataatttacatgaattctcagagcgtctattggtttggtggtggttagtggcgccaagtgctaagccactaagtagaccacaattcaatatcctttttatttgtttcccgatgtaacaggaggcatagccatccaaattttaaattttattactgataaagaataagtagatacatacaaagcgaaataaggctgaaaaattagcagagagaagcagacttaattatgtcgaggggagggaaactaaaatagaatacagtttcccacaacattattgaagaaaagatgaataaaagaccaaatcaagtggaaaactggagatgcaagcataaccgaagcacggcggatatgcttattatgctctaccaaagcattctgttccagagggcagctacacatattgtcactgtccacaatatattcccccaatctctatccttactaattacacactaattataccaagggcaggcatcatgagagtctccttctcccccttgaacccctccaaagcccattctccaagcatccaattcttccacccaccaagcgctcagctaagatgcacctcccaccaagtccatcaccacctcagctccaccctcactcccacccacctccacaccctcctaactaccaccacaaacaaccatcccaacccaaaccatgccacccaaatccatgcccagctcattaccaccaactctctccccatccccctcctccacacccagcttatcaacctctacgccaagtccggccagctcccccaagccctcctcaccttcaaaaccacccaaaaacacagcaacatcgtcacctggacctcccttatcacccacttggcccaatcccaccaaccatttgaggccctctcactctttgcccgattaaagagggaaggcctcggtcccaacccctataccttttccgccatcctccctgcttgcgccgaaacacgctccgtcttgcatggctcgcaggtgcatgggcttgcatgcaagcacggcgtcgacgccgacgtctttgttgcgagtgcgttggctgatatgtatgccaaatgtggtgatatgaatgcatccgagagtctgtttgatgaaatgcctcagagaaaccgtgtatcgtggaattccatgattgtggggtttgtgagaaacaagctttatgacaaggcaatatggatgtttcgggctttgcttatggatggatcggtgagcccagatcaagtgagcatttctagtgttttgactgcctgcgcaaactctgggggattgggtttcggccgacgagtgcatgcgcatgtggttaagcttggattggagtcggtagcttatgtcaagaactcgctaatggatatgtacagcaaatgtgggcggtttgaagaggctttggggttgtttgatattatgaatgagagagatgttgtcacttggaataccatgatgatgggctgggtcctaaatgaccactttgaagaagcttgcagctgtttccaggcgatgatgagagaagaaattctccctgatgaggctaccttttcgacagtcctccatgcttcagccagcctagcagcatggggccagggggctgcaattcacaccctgatcataaaaagcgggttcggtaacaaccagtgcgtcgggagctccttgataaccatgtatgccaaatgtggcagcttggatgatgcgtatcgatcgtttcaggagatgaaacaccatcaaaatgtggtgtcgtggacagccatgattgcagccttccagcagcatgggcatggtaaccgtgtcatcgaattgtttgacaggatgttggaagaggggatggaaccagattacataacatttgtttgcgttcttgcagcctgtagccacaatgggcttacggaacagggattcagatacttcaagtcaatgtctcaggttcacaatatggcaccggggaatgagcattatgcttgcatggttgatatgcttggccgagctggccgtttggctgaagcgaagcagttcattgatacgatgccggtcaagcctgatgcttcggtatggggagctctgcttggagcttgcgataagagcggaaatctggagctgggaaaagaagttgctcagagattattcgagatcgaaccagataaccctggaaactatgtgcttctttcaaacttgtatgtgagacatgggaggttggaggaggccaaggaggtcaggatattgatggggtacaatggcgtgaggaaggagactggttgcagctggattgatgtcaagaacaagacgtatgtgtttacagtgcacgaccaatcccatccgaggacacgggagatttatgagatgttgcgaaggatggaggagctggtgagggtgaagggatatgtggctgacatccagtgtgctgtcaatgatgtaggagagtacaaggagcagagtttatggtatcatagtgagaggctggcactggcattcgggctgataagtttgcccatggatgcaccgatccggataaagaagaaccttaggacttgtggggattgccatactgttatgaagcttgcttctgggatcttcagtcgggagattgtattaagagatacaaaccgctttcatcggtttgccggtggatcatgttcttgtggggattactggtgaaaaaagaagtgaatctggatgtgctcacccctggatgccaagaaggcataattgggggatgaaagttagatcgttctgcgatccagcaacaaattcatatatgggaaagaagtaacaaaaaggaagcaagaccggataaatctaattgatagaggtggctgtgtgtgctgcaatgaggaccaccacagtctgaacatcacaatctgaagtttttctatacacaaaactttgccctcaaagttactcttcttccaagtattcttagctaatttcaagcaggaagcaattatctagcagtggaacatcatcacaatgggtaaggattctaaaattatccaccccatataactatgtaaaannnnnnnnnnnnnnnnnnnnttgacaattatctaagccagttatattcacagccagctgcccaatttggcagcagggaatctttcttgcaaacaacagttttctttatgacattacagagtatatttgtgagtccaaggtcatgtaaaaacagcagcatcgccttgtgaagctcaaattggtaggacaaccttcagcttatggtgtgcaggtgtcccggattcctggtatcattgttcgtgcagctcagcaatggggtgggaatagtgtatttggaagctgtcttctttctcagccctgttttttgtttaatctgtacaagatagaatagcccaaaaataagtaccaatccaggcttaaaaatttgagcgaacaggagaattgcataataaactttaccgatatcctatagttagtagtgcagggcgtttgccccgtgatctcacccctccaaatggaaaatgaaagttttgtattctgggggtgcttccttcaatcttcaattctaggtaattccaacaggtaccgtctccctcccttgcttttatttttgtgtgtacgtgagtacgtgtgtgtgtgtgagagagagagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagactcacctgtaacagccagagagagagtaacctgtagcagcctggtaataagccacggaatgcttgaaccttggaatccagtttcgtaacaggaaatctgcggagggtgaaaggaatggtaatgttgtatgtaattgatattgaagtcattattctcaactaaacctatggatatatgcaggtggtacactaaaaagtcttctcttagagtgaaacggcagccaactatcctacacaattctatattattttcttggaagccaccatccctctccctttcctcgagaccaattttgatcatagtgtaatggatggagatgttttttttgttgagctggctttcttattcgaagtaccagtggtgtactgatagatggtaataggtggcgtcgggatttttgatactacggtttcaatggtgcaattgtgtggcctaggaaggattgaattatgctatatagacattgagagcttcacaaatgtatttagaatgagactagatgattgttattagatggctttctgatccatcttgtgctgatggaagtctctattcatttttacaagattgttgaagaatgatgtatccattgctatctttttaaagtttcatatatttataaagaacctaacagtgctaccatatggttttttatgtggcaaactatatcagttctatctttgagattttttagctaatctttctgttcagttcttaaatattttttttctgatttttatgggtatatttattcttgattgatttaagtcatctgttttattcaaaaaaatagagttggaaaaaattatttgatagtagaggaaaaatcagatctttgaggctgaattgtgaaaagggcatcgatctttcccccaaaatgctgagcttttttgacaacatataatgatgtccaatatcctacttacaaatcaaaacaccacctctccataggcacattccatatgtgcggttaatatactcatcgatcatttagctctcctcttgcatcaagagctccaacttcttgatttgacaatcatgggctcacaagtaccaccattttccccattcatagaacaatatttcattataatttggtagtcttgattaagtaaacttttatgactagctcataaaataagttcatgctggtctcctattcttttatacctaaatgctcaaggtatgcttcctcatatacaagccttctggactgcatggagaaagggattaatctggctaagattctagaaagggataggtccaattggctctctccattatgtgacacatatggtacgagcggaactctagaatcttcttgaaaaataaaaatgacggtagtttcgattcgtgtaaggctttgtatgcattcttttattggaggaatctatgcttcgaaaatgttttagaaagccacaaaactattttgagctggttgtccctcttactgtaactgtctcctgttcattataccattccctccttattccatctgtaaatttcctctgggagaagtttctcacctcctccacttttccctaaaaaaaaaaaaaaaaaaaacccaagttgttccatcaaagtggatatgacaatgttgaaaatttgtatagttggcaagtaatacaaggtacatatgtaaagtcatcacccccaaccgaacccccacagacatgcagggcttgtcgcttaggactacagaatgtcaacaagagaagatagatgggtgcaggatgctgatggcatgtggtgattgaaacaggcagtgtgcattgcctttgtacaacctaaggccgacaaaatcaactttagatgtgaagttacatccatcatgttggattccttgagcctcatgatgtgaaactttggaatagtatatgctagttgttgtatatatttgcgtaataattgccctcacgagtctttttgcttcgattctctctcaattttctagtagacacttcctttttggccactaggtagaaagctttagacatcaatcttaacaaatggcatttcctttttggccacataatttcagcgtatccaaggcgccattccctgctcaccgcaaaaaaaacagtcatttctttggggggaaaaaaatctttagagagagagagaaaaaaaagcagcagcaagaaaacaatagcggatactagagaagattgactgagaaaatccaacattacctatttttaacatgttctgcttcattgctaccctttttgctcgctctggtttttcttgcaaaaaaacacatgggagttgcaagctattgtgtgaaagattggagtcctgatcctctaccgtccatcttccgcaccgcaagaagagctttggatgcttggactgctgtcgtattgccccacctctgaaatggagggctctcgcacatcctctatcccgagtttttggcaactattcacgtatttggcatctccactccgatgctctccattgctgagatgaatgagctctctccatttctgagatggatgacatggtggtgatcgacaggatctatgctcaaaagaacatggcatatacgagaggaaccaatgatctatggatatgaactgctgattgtcaaagccatgggaatagtcataagtatcatattgaatgttttatctgtattatatgcacgcacagagacactcaaatcttttatcgtacaaaatagcaggagtagacttcaagggtattttttgagtatttcatctctttatactcaaaaactcaggaccaagtccagtctggccccaatcaggctaaaatgtattttttgggcctcgccaaaccattgggacccgttcatatgacacaaattctggctcaggctcttcatcagattggcctcgtccatcaacagtcctaaacctaagaggttttacataatatttacaagagcccacgaactcaaggttgaaccctcaaatgcgccagctgtcaaaactatagcatggttaggtggcatatctttgtgatcggtgagatttaggtgcgagcatcatctagtctgctatcattccttcaaccgaccgataggtctcacatactcgatctgtatcacattctttcgacttgtgttgtaaagtatgggactgatttaattgcgttaattttgatctatattctacgaaggtgtgttagaaaccaactagacccttttactagtcctttcaaaaaaatgatttcagatccaccaaatggatcaaatcttctatacatcgcatcttataatttatactttcaggtcccataatgctttcattccttcagtaaacagcaatgagtggctgattgacaagtgattcctatgctggctgctgacttcattagttctttctgctttcagctagagtctgtgggctacaaagataagaaccatattaaacttagggagtccattctgatgacacaaggcaggcaatagtatttgcatcttgctctcaactaagaataaaagaattcaagaataagtaattttttccaacttccagaagtcacctgcatacagctcaggagagtgcaaacaaatgatgattaactctatatggattattccttctatgtttcagaagcataatgatgagaacatggtccgctggatgcttaaagagaaagatttgcaccccacaataatgttatggacaacaaaagcgacaaatattgttgcttgtttggattatatgacaaggttgaagagatggatccagttggatgaagtctgctgtgtcaacaaaaagtctactatttcaacaaatctatcagctagctcattcatcatttttgttgtttttggtctggaagaagtcttctatttcaaatgcaagctggaaacttattgttatcaatctttcttacttttggttggccgtatttatatctgtcatttctatcacaaacgtgcatgtaattttttttttttattaaaaaaatttagacgggcattccctcacttttgtttattattgtaaggatccggattttcttaattctctagcacaaattttaaaggattgaaaaggaagaaaagaggaatcacgtacttggcacgtgaggggaggggaggaagagggctacaatcggaattttatttttctcctaatttgttattaaaaatcagaaataatctcactaaaacttggattaaaatgactccaattcttatttacaaatgctgatccctcttccttggatttccaccataatttttttgaaaaattattgtcggtttcgagcccttatccgagtatttccttgggttttcatcggagaaatcattaggtttttcttgtttatcctcgttagacctaggtaagttattaagcctttaatttttcttcttttttgagtttgttgctgctgattggagccgatgaactgatagatttggacaagaatagggttttctctgttttgagttttcttcctctattttatagatcatcgactgctacggctactgttggagatacgtttcagtaggcaccgagtgctgacattggttgctggctagtattctacggccatggccagatgaagagggaaaaagaataaaatttgggtgctttgtttaaagaagagagaaagggagaaggctgcctctcttctctctctctcccctcttttatataatttctctcttctctctctcactaagttgagaaaataaaaaaaaaaagaagaggttctcctcttttctctttcctctctttctctctctagattttttctctctcttcatggattttttctctagagatcttatagaccagtggaaggtacaagtacttaggtaacccagatcaattggtgaccctgagagaggttctggactagtagtgttatggccatcttttgtaatttttattattcatgattatctaaaatttttatgttgatcttgaaaatgtagaggttcaactatttgcataagaagatgtcaagtggaacatcttgtttttgagttcgtagatcgagaagttcattagtttctgtatttggatcaagcaccgatagagataaggattgttggacacaaataatattatgtatatttatttttttcattatatgattttgatttttcattactgttatttattttatgattatcagtataattatttgaattttttatgtcatatgctcgtatcaaatatggaaggttttcagatggtttaggtaataatactgaaaattaaaaattttgaaaagaatataatatgatacaatattttcttgatataattgaaatttaataaattgatgattaagaaagggatatttggattaggcacgttagattgcgaatagtcttgtcatggatagaaatgtgatactaagaatagctcgtcatggacagaaatatggtactgagaatagccccatcacggtcaggaacgtggtactgagaatagcttatcataaacagaaatattgtactgaaaatagccctgtcacggacaaaaatatgatactaagaatagccctactattggtaagaacgtgatacttgagtttgccagtcatggatttgagcatgatcgtcattagttcagaatcctaaagataactgttaattgattcagattatgttaatgtggatgatatgatatgaaatcataattaagtaaaaaaaattacttaattatatatatatatatggtataatagtttgaagaagagggatatccgatgatatatgatatatatttttgtatatgttggtactgagttatattggatacatgatacgaggttttatagcttatattttcttttgatactattcattcgttatttttaaattattattatattggtgtgagtatgtaaggattattattagattgtaaagttcataattcttttcttttcttttttaaaattataggatgttcatatttagctaaggttgggatctcgaattgaaaaatttgatcagatagaacatcatcaataacagttgaataattgagttttataaattatataaaatttgatatttgttaatataaaatatttattatgaattaagatcaatagtattcatgggatcttgagattgtaataaattttaatatcttacatgatctctaggatgttactctaaggtttatgggcccacatcatgtagccgacctgggtgctgggtttggaatgtgacaattatttatctcttgtgccagcatagtttgttcagcactttaattagtttggctcttctaatacaaaacctcctagattaagttcatctatatcagaaattgagtaccacatgccataccttctatcattcaaatctctctctctctttttctcctaattttcactggaaaagaggctgaagtttgttgttcaaatcgtgatgataaataatcgattccatagtttctgtttgcaaaagcaaggtctcataattcatgaatggttggagtttcttttactcaacaaattggttgacagagttgcacaaggaccacattcaattcttaaaacaaaagcacacgacagaaaaaggcgagaggaaggaacaaagcacttccaccttaaaaatattttctagctttatacatctctttagcccccattcagtgtaatgggtcttcgttgcgacaaagttttcgaacatagcttacatggagcatggcaaatgaaacaacacaaaaaagctcaagatatctcatttctatatggctgtacatcttaaaccagactactattcccttttgtgttccctgttgctgttaaaactaacctccaagacaaaaatggagtcggtggcggatgctaacatttatcagctcttgtgatcttcagtctcttgacagtggtcaagaacatcctgctcaaaccaaaggtaagaaactaattaggagagaggaagaaacgagcaatggcagatagaatgatagatggaagaataaagctggtaggaatcatatcatactcccatgggacatcccccaccatcatccagtctccttccttgtcttcataggtcagcacatgatccttactggtaggcacttgggcaatatcagggcctgatcaagtgatcgaaacaacgatgatggtaattctaaggctaattaagatgtatatatgcaatgaacaatttgatgctacaaaataatacaagttgcttgtgtcggtgcttacgcataatggaggtcctaaacatgcggcgaagtgtctttattaggccatcatagccatcaagtgcgaacagatccaatttcctgccaattggaatcccctccatgtaaaccttgacaaagaatgtagctgattgcctctgaatctgatgtcctttttctgccagtgtgctcctaagaagcggtttgatcggtggccaatcagatagttggtccctaatgaccaacaaatagagaaggaaaaagaaaaagaacaggaaattgaatcaggatgaaagctaatctatagataattagccgagagtccatggaacgtaggacttgagtaaactatccaaggtggttaatagaagggaaataaatgaggaaagagtagcaaaaagcgactctaaattgagacgaggatgggaaattttatggatggtatgaattaaaaagcaaggcaaggaatgaaaaagaaagaaaaaaaaatcaactagaattcacatttgagtgctaaaaataagaaaaaatttaaggaaaaaaaactatggagcaaatgatggagcaggagatcatcaatgagataatttggttcttgtatctcaaaaaagaaaagatgaacttggaaacgaaacatggatatatacatagagaagtacatgattccatttctgattaatttggtaggcaatagagaaaggccatataaagattaaatgaagtttgattataggaaaggcctttagttctaatattgaaacggaaaagaagaaagaaaacatacatgcatactttttttaaatgtgtgaactgataaaaaaaaggaagagggagacaggaagaaaaagaacagtatatgaaaagaagcaatcggcgtagggttctttaagagtgctgtaccttgcactggaagaactatcctgcagagaggaggctgacaggctaagtcctagccttagatctgtgctcaagtctctccttggctgagagagagaagatgcagtggagagagcagggtggctgctgctgtcgatggatgaagaaggcgaaccgttgtttcctcctcccattgcaaccagagagagagagagagagggagatgccaccctcgcttgtttgttgtagaagataggagtgagaaagagaggacaacgattgatatggagacagacaagagggtggcagaagaatgtggaataagagcttccttgcaactgactattaggtgtatgagtacttctgggggtccatcgtattggttgcacttcgaatacgtggcagaacagaagggataggcctagagcaagcttggccaatggggtgttggggtgacaccttgttaggctattggttggacttggccctctccacaattgtccccaactttatatattctatcaattagagaaaccatgaatactcacactttacactatcatgccgagcagtgtatggacacttgaataaactataggtgatacattctacttgttaataaaagccttccatatcaatgaacatgttgggtggttatgggggtatattaaaattatagaccatagaggggatgtgcccacactatcaaatctttgcgagggcaactttcccaccatttttttttttttttttgtcgatataaatacaatgaatccagtcattcttatttgtttgttcgtacttagcaatttcggggagagggaaagatgtgtgggacttgaactattttacttttggttgcactcacttaatttacttggatggtaacttacacacaacacttccaccagtggaaaagaattgaatatttagaagtctcccttatcgagatcaattaatgcttcttagctatttaggtacatcaaccaacttcatatgtactctttgattgctaacttctatcatctagttcttttttactcaattacgtgtgatattgtacatttcatggtatggctaattgacaaccaagtctagcctagcttaccaaaggatgggataaattgccatggttaagcgatggaatcatccatctctgcaataattctccagcatggtagctgcaattgctcaaaactagaacacagggtcgatatctgaaagagaaattgaaatggactcaatcgactagcctacggacacgacaattggcacatttggcaaggctgtagaggattgctgtgaccggcaagacttggctgcttcaagaactgaccggcttttttcagcaaatccttagtcgagcattaaacagatggttacaggacctgcgaccatgacaattcaaccactgaccttccatttaatctatgcttttcatgggacacacaatttgatcagtcaaagccacatgttttcccaattttgagactagctcaaaagacccaacaatcaaacaagattgtcacacaagacagtggtaggaaaagtaaatttctatccagtgggcagacaaaccaccatcttctttcttgtttggtttctcccttttcctttgacatcacatgcaagaagaaaagggatccttctcattgtttacacttttcttaacagaagaagacctataatacttactacatccatatatatttattacagattgcgtattcgcctttgaacagctcctacataagctgatgagctcctagaattgtcgacgatatttgttgtgccaaaaatacggcaagaaacgcattgaccgatttatgcaaacaagcaagtagccgtatgaacatggtggttgaggaaaaaaatgacaaagttttcggattctgatagtgagaagacaagtttttggattctgatggtgagacaagttgcttgatttgttcacgtgctaacaagatcacatgcttgtattggtgttactccgaattaatgtaggtttcttccggaatcaataacatagtatggtaagaatggaattagataaagtcgataacaatgttaaattaggtggctaaatcaacatggatctccggttgctgattatctcaaaataaagtaatggtaggaggggaggggcaagaaaaaggcttaaggaagaagctgttgaggaacaaaggtgcattctttatggagacagtgaactttagaaacaacgaggcactgtgatatattatcttattgacgggggaaagagacaaggtgtgcatggggttcgaagtttggaataaaaaagttgggagacttagaggctttcatttggtaaaaggttagattgtttaaagaagtgcacgatcctcgcaaaagaaagacatgagagctacttcaaggagacatgcaatcaactatatctccagacactagaagaaaaaagaaaacagggaaaaagccaaccgacccttggaccaaccaacaaccctttctttctctctctctctctctctctatctctcacagtattccaattgtcgcagtaggcataacctaactaaaaatttaactttagtcggtgctagttaattagtataaactgtaatctgttatttttggttggaagcaagttgaaactgccatgaaggtttctctgcttgaaggttgatgtcattgtttaaaggctgagcgtagtgtgttccttttgcaaaggaaattttattttattttttgctgacaagaatcctaatgagttgaagttactcctcctttgtggagagacggatgaaattagacctgcaacgttttccattcagggatccccaaaccactacaagtccaaagtgtgtgtgggagtcaagaggagaaaaatgtgttaaagatcgaggactagatgcaatttcgacgatttccttttctctagtaaaggaagggaacacctggcatatcttgttcctaaagaaatggcaaattgaaggatggtgcagtaacaaggggaaaaaaaggggggtgggttgttcccccgtatgttgcttccattgaggcctctttctcttggtccgatgtcctccattggtacatgcactttgtgtgcacctcaagcatgtattccgtggactccttggatctctacaagctctttctttcctttccatctcccataatgtcaatatcaatcaatcaaagcctctcgattgatcaatcaaaaacaagtaaggttgtcaggtggccttcaagaaaatcattaatgggtagaaattatcaaaaactggggagcttttccggagaaattatctctctacctatggattttaacttggagacctttttggagattgtgagtacaatgtatgcgaactccaagtcagcatgaggacacgagggagggggatgtcggatgaatgcggttggcatgagaggaatggccttgtatgatgtgcactagagtcctagtccccatgggccactttccctacatctcatcacattgcctccataatcccatacattggattctttatttcatctttccagccctttgcaagcccaatagaaaggggcaaggacaagcaagcagccccctgcactcaaacccacttttcttcccttccaagctgttaattcctagtcaagtctctcatcataatgatgatgtccaacctcccctccctcggtccttttcacccctcccacccctcttaagctttgatttcaccagtcgagactaaaggattggatcggagttccccagagagacaactttccccatggtggggcctctcttggatcccacttcctggcatctgctttcgcggactctgttggcatatccccttgagaatgtctgggtgatgtttttcctgcactggacttctagaaaaagtgcatgtagtttgattaaaataataatgacaatggaggtgtggttctgctacgagttccatcctcacacgcaagacctccgacccacttggtgataccaatgtgaccgtgttcttctaacttgagaaaaaaaaaaagttaaccatgaagttggggtgctggtggcaaggccagtcacgttcatacattatgcatcgttcgcagttcttggtccagactttgccaaatcacactcgatatcaatcctaacaatatgatctaagattaactttgccaaatcacactcaatatcaatctgttctagtacccgagggaaaaagatatctagttagaggatggactcatggttactagtttaatttcatgggcatacgcatgtggaagtccaaaattaatttagtgtcatgataacaaatgtttggatttcgtactttaataaaagtcgggtggctttttagcttccctattcctccaaaaaaaaaaaaacacatagttgctaagtcaatgtgaaggcaaaattgtagacaaaaagctttactttatcaatttgatacttacataggttgaagcactaacacagggttgtcggtattgcttttaagagttttatcttgggttgtatgtgctcctcttcccttgccatcctagtcaatggtactccgatgattttctttcactccacaatcggatttccccaagattatcctctttctccttatatttttgttctctatgctgatgccctctctcgtgttctccatactgcaatccaaagtcaagaccttgatacatatactcttcctttatgggcccaactaatatcctcacttactcttgacaaatgactatttcttgctaggttgggcgatggtataggaagccatgatcttcatgagaattctaagggattattgtactgtctctgagcaaaaagtgaacccactaaagttggttatctactttagcctaaagattaaacctcatcgaaggcagacgatcagggagtatttgggcatgggagtaggtcaaagtgtggcactacgtaggggtcccgatcatgggtcagagattgtggagatcaaagtatattaagatgaagtaaagcattagggagaggatggagggctggcaagtcaagtcgctatctatgatgggtcaagtgatgttggtccaatcagcctatgctctatgccaattgtgatggcccagcccatataacaaactcagcccaccaaatatgagaaatatgatataaataataaaatatgagaaagagagtttctctctctttcctctctctcttcagcctgaactagtattttctctctctaaaattgaactttctctctctattttctctctctaaaattctctctctagattatttctttctcctaagatttttagaattttgagaagaatgatgatgaatttaaatgattctcatgatgaatttttgatctgtgatcgtcggacggtacaccgacatccactttgatcagatcagatatttttagattttatttatcatgattttattgaattgttcacgtgataatcttaacatgatttgatctgatcgatcgaatttgttgaatcatattatctaaagaattcaagatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatcccagccaaagggaactgggacttttctttggtaggtaggtaaggattggtatcgctcatcgccagaaatgcttggaccgcaagggatggtgacgattgatttgcttgtttgctgttggttttaaatggccggtgacaactcccaccaccctctcccctccatgattcctttaatcaatgcctaatctttgggccaggcccagttctgaagtaggaggactcgaggctgcttccaccacgctgttcgaagtcccacaccacagtgccttcggtcccacacgcaaccatgtctccattggatgcatgaattggtgatgaggcaaatcattatccttggtgtccagtagtgctgtggaacagagacttccacagctggccatctctctaccgcctctcttctggtcattggaactaaagattcttgaggaaaatggcgagtccggagtgcatgaccacatgatctccaagacctgtagcatgtaactcggcatgtcgataaatggctgatggacggccatgaatggagattcctctcaccaagacttctctctaggacaaacaacctaaggacatttcacgtcataaagttggaagaagataaaaagggagctggtccacctatgcactcctgtcttctctcagttctatgatatctgggggacatatatacatgcatcaggatgacatgatgtcatgtgaagtgcaaatgctatcttcatttcagtcactgtttctatttgtcttgctttaaggcctccatgctctctgggcctcaaacatatctctccccgaacttccatccagacagccttttcctttctcttatcctcaggaccatccaacacttaaagactaaaaagtggttttcaggtcacttgttctctcctttccttgcacaagtatgataggacaaaacaatttggagggatagagtagcttattttccctaatgaaagcgttttagctggaacatttgttacagcatcatgcaacatgtgctgtaaggagtagcctttgtggttggactccctccttctgaacaggggtgttccacaatcaaatctgagtgacatttgattggttaatgttgacatagattgatatgatgattcaatcattctttgaatctagtttagatgcaatttattttggtatagatttgtatctgctaaataaccagtccataacgcaaaggaaacacaagaagaaagaaagaaacagaactgttttaagtccacaaagttgcttcatttttcatcttttatctattggcaagcctgattgctaaccctacaaagcgatcgaaagagttagccgctgaggatcagattggtataacaaacgccaaggaccagaagaatacaaaaagcccgaatctttaaggcatgtattgacttaagggcgacgcgtcttgagcccttccattttacttgggcggtgcctcttgtttgaggtgtatcgcgagtccctctctaaatattatatatccagctccatacccaaagaaacaaaccatagtgccacgtatacagcttactgatccttccaacaatctagccttttttaggaattaaaagctacttaaactattcaatcaaaaaaaaaaaggaaaaagaaaaagaaaagaaaaagctacttgaactatatgattatattaatgcaagtcaatctctttctttaatctaataatgatagtagtacaagttgacacttcatagcagatgctagggataaaggatctcacaacaagaatatatttaatatatttaatctctccagggtagctttcattttaatatggccagaagatcttatctcttgtccaagaaactcgctggcattagcagtgccagcaagcaatccgggccacgggatggaaacctttgattaatcccccagccagtcaattcaatagaatgaaacgggaaaccaagtgcagcatgtcttaggcatagttgatagtcttctaagccatatagccgctttatcgccaaaaaaaaggccatataactgctttatcctcccctgctgccagactttggccaccttcttcgggaggctttggatcaaacgctccgttggaaatggcgctcggggatttcaataaagaaaagtctttggggatttcaataaagataagttttaagtttttgctgcagttgagcgtactctgaacgccacttggttcaaatccaaaagatttttgctggaagaagctgtctgaagccacaggagatggcttcatggaagttcgtttctctttattcgaatctttttgcaatttgtgggcgcctatggtgatagttgttggagttgttccgcaaattgagctgccttgattggttgtatcaggtgttaatgaacgatttttttttttttttgaggaacaagtatctaggagtcagaaaaattttttgtttgggtttctgttaccgcttgtttgaattctcaaaagcttccaagttttggttccgactggttttgatttcgtttcttaatcttagctaggagattggtcactaaaatgatactggatttcacttggttggtggttggaatggacaaggagcaattttgttgcaaaatggctcaaatatagaattataaaattccgtgctttggagaaaaaaggaaaaaaacgatgacttttatcagtctctgttcttcaaggtgtgactagaatgcgatcttatagataattctgagaagtgggtctaaaaattttcgcatcaaagttttaagcctcttctttatggtccccccttagctcaagtgtccatctgagtgtgtcgtcttgttcaatccatcatgccgctctctgagttccatcagacaagaaaagttgatactagccaatccaagatgaccaattgctcatctgatctgccttcttttatgtaagcatgctcgccttatatattacctggtaaatagtgaagctttttcatttactttttgttggatgagtgttcctggtttcattctgttgatgtatgctgatcttttctgattttgatccatggctgttgaacaaaggcccgacagtgaattcgtcgaactgctgtgggagaatggtcagatcgtgatgcatggccagtccaacaggcctaggaagagcttcttctccaccaccttctctagagctcaggagaaggatagcagagatgccgttatctcgaagaccggacagatcgaagctatggatccattggtgaatgatttctctcccaccgaggcctcgggtaatgcaggtttgaatgctcaggatgatgataccgtcccctggattaattactcgatcgaggattctcttcaaaacgattactgccaagattacatgctggaattcccaggggcgagcctgaattctgtgtctactcataccgaaaccgtgctcgcggatagaagccatggtttcactcagacttccgcaaagagttcacgtaacgtggaacatgggcgcacttgtgaacaacttgcaggaggctcggatcctagccggattaagtgcagccagttgtttcagttgtcgccggaacggcggagttcggccccgagtatgaagtcgagggcgacagagttgagcaccagagcaaccagtagtacgcaccatggtctggctgggtatttgctgagctcgaggctggaaaagcaaggtcttgctagttctacgttgtcacagtcaagcggtagcattggtttgacgaacttctctcatttctccggacctgctgcactggccaaagccaacctcctgagtctcgataggttgagaaacaatgagaaagcttccaccaccaccagtagcaacccgatggagtccaccagtggtttcttagcaactccagggttggcttcagcggcacccaaagtagagcggagatcaactacaaagcctcaacaggaaagggtctcggtcgagaagccagatgccgatcatgacggcaatgtgcataacaataatagcatagtgcccgactgcgttaagcgtcagctctcaggaaggaatgagaccgaaaagggtcctgaagcagctgtagcatcttcttctgtgtgttcgggcaacggtgctggggcagcatctaatgatcctaaacacagagcgaaaaggaaaaattatgaaggagaagaatccggtaatcagagcgaagtaagtcaaaagaatcatggatgcgtactgaattcttctacttggattgttgtgcttagaatctgtttaaatttctatgtaggatcatgaggatgagtctatgggcctaaagaagtctgctactgtgcgaggcacaagcacaaagcgaagccgtgctgcagaagtgcataatttgtcagaaagagtgagtttggatgcaactaacctgcttgactcgaataatccttcttagtttggattcataacttaaatgaagaatgcctgatatctgaactaatgaacagaggcgaagggataggattaacgagaaaatgcgtgcacttcaagagctcatacccaactgcaataaggtacaatttttgtccatctaaatttagtgttcatgttttttaatgcagtggtgaattttgaaagaggttgcctgattgatttcgaataacacttttacaaggtggacaaggcttcaatgctcgacgaggccatcgagtatcttaaatctctccagcttcaagtccaggtgaatattttggccctttctccccattaaacatttttttttttctttttggttggctagattctcaatgtaatcctttgttttgaaaattttcagttcttgacgcagatcatgtcaatgggaagtgggtcatgcatgctccccttgattccaccggctggtattcaacagcacatgcgcatgcctcccatggcacatttatcacagatgggtgtaggcatgggaatgggcatgagattaggttatggtatggggatgctagacatgaatggttctgcaagttgccctctacttccgcttcctcccatgcatggaccacagtttcctttcccctcaattcctggaacccagggtctgcatgggatgcccggttccaccggtcttccaatgtttggaattccggggcaggggcttccggcatcaatgcctcacattccaccacttggttctccgtcaggcctttctgccacaccggactcgatgcctggctcagcagggatgactaataatccattaccagtaacagatacatctccctcatcaacttccaaggatcaacatcaccgaagcctagacttgaaaaaaatacagaaaacaagaaccgacgacgcgcagattaagaattctactcaggttaaatcatttttcctgacccataagtactccccgtcgcatgatatcctacttcagatgatcagaaaaagactaaagttcttctgggtatttctgttcatttttctgtattctgtttgatgctctctctgtcttaacatactggtttttttaaccaccaggaagcaaaagaatcagtcaaaaagtctgccttggtgcaaatgagtaatcagacattgcatgctaccgggaatggagtccaggccaaaaagggagtccacccaccagcacaactggtgagtgggacacatgacatggttggacgatcgattcatgctgaaattgggttgtattctgaaaggacttgtacttatgcaggcgacggttgattcatttcaggcactggctgattgagaaaggccttgcataatttggcagaagccatccacttgacacataagatccttagaactttcaagtagccatccgttctcccagagctttccgggcagcattcatggtctgccctttgtatatcgagagtagcgggatcctccgtgcagtttctgtaaattggagagaagatgaggtttcagggagtgtagaaagaaaggtgtgttgtgcacctctgtaattaagcatttctattcgttaatgtagcagtggctccttctagcatgattcttgttcaagttggaagaccttttgcttgtgatagatttgttctgacatgcattatttactgttttgggcctccattgcgtgccatctcttcatactatagtcaaaaagtattgcccagctactttcatagattagtagctaatgaaacagcaactgcgtaccataacgtgattgcagcatcgaaacagtcaactcgacaagaaatccgttaaagcttatcctattgcaaatcagcaagttaacacgctaattctcgttcggaatagcttgtaaccggtgactggtacgttgggccacaacaagattcatccccttctagggtggctgttggttggaattagatgataaaccgatattgaagcgggaccaataatagagcagaccccgaatggataggataaagacttgttttttttttttttttttgggtacaggataaagactgtttttgatgtatacatgtatggtcttcatcaagcttcaattccttttcggaatattcagaatgctaatgctagacattggagaaatcactgaatgattccatccgaaatgactttccttttctaattttggcaacttcgtggcttgtcatatcatcccatccaagtttttttttattattattttatttttttttaaggtggagaacaattacctaaataaatgcatgccaactcatggaaagcacctccgttatctctttctgcttcctctatttctccatcctccgtacattctttaattcaattcattgggggaagtatcttactttattccttccctcaaaaaggaatctactatgtgcatgcatctctgtaaagatagttgcagttcggtctcgtcaacaatactagtcttgtcaccaaactgtttcacatttaactttctccaatcatgtttctcactgaattggtgtattctcactcacgaacacttaataaaggctaacagtacctacttctgtcagcatgtctctgatcgtttgtcttcttttcagacacaagtaattgtcttcttttcaaaacacaagtaattgacccttaaaaacagagccaagagctttgtgggccagtattctccagatgtgatgcaagattggcatatggaaaagaatatctcatccacatttttttaaacatactaggagattggtcgagtgcataaataaaatctattttgagatgagatataaaataaaatcttataaacaagaaagaaggtcatatcgagttacaaagtttaacatttcatttgtgatcaagaggctgcaacgccaatttcatttcccaagtgatcagcaaccttctggcttcctgaagatctcaaaggcaggcacaactagtgtagcaatattaaaagaaaaaaaaaggtcaaagtcttcaaatctgtaggcactcctgatggtttgtaaagattctcttctcatatatccttcaatatcttaggagagattggcatcatcctgctgctagcagagctagggggaaaactcaaacagaatggtctgaatcatctctaggagcattttataggccaaactgcccggggttaacagaagttagatagcccctaattgttcatttgttacagaatcttccacatttagccattcatttttgttaggccatcacatctcaagcatactaacaggtgacttgcaacacattaaaacaaacaaatggaggatactaaaggctccttcaacaattgtttccccttctccaatataattttgtagaaccttaaatagtttgggttgaatttgggggcaaaccacttttgcagttggatggagcattgtatatactcttctctcacaatcaaggccaataagatctaggatatctacccaggagacaatcatattcaatgcccatgtgattgacattagcaatcatgcaaatgtctctatatctctatggtagctggcagagacaatctaaggagaggtgagcatttgagaacccaaagtttgaatatcgtcaatcattcagacaaacagattacctaaatcaaccaggatagcaatgaaatttggcacttaagagaagtcttgttattgtttcaatcttcactctcatgtctttagcttgacttcttctggtaacacaggtttttgccagctgtagtactaataatagatgtttcttggtttcatatgtttttcaattctccagaaaggtttggatgacatatcatggctgcttaaaatcatgcatgcattaccctgcacagtgctaataatttctagatcttaccacttcattttgaggcaacaaattgatcatcataccgcatattactctaaagcagcttcagcagcatgaattttgccttctccctgaagtcatccagaaataagctgtatcacgctaagatgaagagtaacggctcattgaatgctccagccatgaggcaggcttgtgtcttataggaatttcctaatgaactgtatagggcactgtccaatctctctctctctctctctctcacacacacacacacacacacacacacacaaaaagaaataaatgaaaaaactgtgctagtcgagtacgtccatgacaacaagcagaagatctttcctcaagggattacaccaatggctggtttttaactgtaacaaaaataaaggatacatgacaggaatgtagtttgatagtgaagtcttccagttcgtcctcttgtaagtagaattgaacaaaatctagtaggcactaaacagaaccggagctgtaagaagagaatattgacatatatgaattaaaataaaaagagaacacatacatacgtagaagttcaaaagaaactggtgcaataaaactcccacggaaaactttgcctttgtagccaaaaagacttctaagacaaattttagatgctttagacattcttacatatattgatcggtatgatatataagtgaaatgattcattaaaaagaatatgactttacaacaacttgagacaggagattcaattcaaagagatcttcaggataagtaggaactggatatgatgcttgagactctaaataaatgagtcagacatgtccctacaagactccatggagtccctgcactgcgcaaacaataaatcccatttgctacaatcaccctgctcatctaagatcaatcaggtttcaccatggttaggtttaatcatggttcctttcttgataagaccaaaacagtttgccgctgcacatgttaagcatcgtggttgaagcaccgcagatcaaaccaagaatgaacaagcaatatgaagcttgtatcctgtatctgattgaaaagaaacagaaacagaagatatctgctataattggcccttcccttaatccacataagtgaaatcatcctctgctaaattatgagggaagctcatgtcaggaacataaccttcctccctcatctctaaaagtaggatgccaataatgtcataaatctgatcaaattctgcaagtgaccgatctctagcaagaaatggatgaatagaagatccaatctgaatccagctactgcctggtttcttcatcaaacccctgtcttttaccattgttcttacattcattacatctgcccatctcccagcagcagcatatatattagacagcagaatatagtaccctggatcttcaggcttcctttcaaaaatctgtttactaacaagctcagcaaggtctagtcttttataaactctacaagctcccagaaggcttcccaatacatcaatatctggtttcactggcatctttctgataaactcccatgcctcatccaggtacccagatctgctgtaaaggtccaccatgcatgagtagtgctccatttctggaagaataccatagtcttctatcatggaattgtagtagtgcaagcctcttctgagaagaccagcatggctgcaagctgaaagcagcgctataaatgtaactttatctggcacaattctctctccctccatatggctgaagaatgaaaatgcctcaataccatgaccatgcattccaaatgcagcaattatagtgttataagtaacaatatccctttttgtcatctgctcaaaaaccttcttcccaaggtctagacacccacacttgcagtacatatctatcagcgaattattcacagaaatcatgcaatccagactggctctagtcacgtaaccatgcagttcctttccttggttgagcatagtgaagcgattgcacaaaggaagaacagtcaccatggtcacagaatttggatgtaatcctgattcccggatccttcgcaatgtttggaaggcaaaatccacatttccattcgtggcatatcctgctagtattgagttccctattgcgatatctctatccgacatgatttcaaaaatgaactccgcttctctcatcgacccactttggcaataaagatcaaccagtgcactcgcaataaatacatcaaactcaaaaccatgtctaatggcatagccatggatctcttttccttgcttgagcagcttcccttctgaaaaactaggaagaacactagctatagtgaccgaactgggtcttacacctgaccccatcatctcaatgaacaaatccacactctcactatattcacagttctgggaataccctgcgattaagctactccaagagactacgtcattgtattccatagaacggaacagatgatgagctaatggagtatatccacatttacagtacatgtctatcaaagcatttgaaacacagagatcatcaccaaatccacttctgatggcacagccatgcaaccccattcccacatgcaaagctcctaacctaccgcatgccggaagaacagtcgctacgatcaccgaatcggtctgtataccttccaacctcatacttctaaacagattcaaggcctccaaccaatctccatgatgcatagttccacagatcatcgctccccacgagaccacatctctcatcggcatatcgtcaaatactctccgagcttctcttaagctgccacactttgcaaacatgtctatgagggcgcatcgcacataaagattggattttgaatcgcaatgaacgctgttggattcgatcgattcctggacctgtctgccctgctcgagagccgataattctgaacatgccttcagaacgagcgggtaagtgaaattatcggccggcaggccttcagtcgtcatcttgcgataaaacgccaatacctcagagaaccgacccgcattgacaaagcctttgaggatcgagttccaggcaaaggagtttcttttcggcagttggtggaagacaagcagggcttcatcaaagcagtcaaggctgacatagatgttgacaagttgcgagcctaacacgaggctgggtttctggtggagatagccgtgaactagtatgaggccatgcagctttctagcttcatggggactggtcgttgatctcaggtgaaggaagagggtacggtgggagaaggaagacggttttggcagatgagattcctggtactggctcgtgggagatggacttggaggcgaatttgcgatggaattcgaatgtggcgaaggcggaagtctgggtctggttctgggtggcgctgagaattggtaaaggccaaggcatgtggtgatggtttctctcggtttcatggcagcagtttggaattaccgttgggcatggctattgacttccaatttgtcagagtgtcgcttgcccccaaaaaaaaaaaaaaattctaatgttgcactgcaatggtagagagcttccggaacaaatggtggctctgtacctcacacccacacacatacattaaaaagaaaaaaaagaaaaaatcatggtggctaatattgtattctttgtggttgcagaagcattttataaaattcttattttttaatctgtgttatttttttaaaatttttctgaacttgttaccaaagaaaaattctgaacttgaaaaaaatgaagaactccatcttttttaattatggtgatcacaacataagaacacaggatggtggtaagcggtaactactctgactttgccaccttacgataggcactttttcttctttttttttttttccatttgcatatatccgtttgcttcttctctgcggtgagtttggaccctctccggtcggcgtttggactggaaagagtctatttattcggactggacagaggctctccatatcatataaatttaaattgtggagaacttagaccaagcattacccatcgcactatatataaatagccccagtagattctaattactctcgcatttgcgccttcgttatccactctatgttagtgccgctaatggcagtagctataattattaaaacacatcgtgttggcctatgtctgttttccttgcagctacatagatttaacaaaatcctaaatgtcaatcaccgtatacgaggaataaacccctaaaaactaaaggtggtggagggaccggaccaagaataatctccagttggcaacggtgagaattctgtgaaggcagtccatagcaaccaaactgtaacaaccaacatcaacatcctagcctataatcatcagtgcttaggtcagaaaagaaaagaaaacaaaaaaaaagaaaaaagaaaagatggtcttttccagcaggcttgtcaaaataccattttctggatactgttccatgcaggcacaaggctaaatctctgacatagtttagcaaatacaacttcctcagaaaattctaagcgggcatccagaagatagcatcgtcccatgtgaggttgcttaacaaggaggagaaactgcaaatcataagataaacactgcaatgaacccttttttacaatctctgcataacaatgtgttccctacaaaggcctgcaaatgatttgttcttctgtcaaacatattgcagacaaaatgatcagaagcccagtaggcacgaactaaacagcctcaagattgagagttgacagagttttgctcagggaatcaacagactcttgagccttcacttcctctgcaccttttgcaacaggttccaccacttgaggctgaggcatttcgtctgcaagttccatttccagcatcttaaactcttcttcgacatcttcaccatcaatatccatagactgaagtggcattgattctgcaagaaatgcaaaggaattaataccatatggaaaaactaggacatgcaagaaagccagatagacaggcccaatccaaagccagggctggcaagcctgacactgtaacaatcatatatagcttctacatgataccataaggaatgaaatgtgattcaaagtcatgatttttccaaacaaattatatgatttttatacaagtggctcaagcagagatgaagcacgttacccaaggcttcctcaacttgcttttgagcagcaacttgctcatcaagctcttgaagatggagatgaacttcttccacactgatcctgtgttccttgattgcttgagcacctatttggatagcctcagaaacctgatgtacaatgatgaaagaaattgaatttatgaatccaagttacaagaaaagagtagcagtcatgacagaaacttctcccacactaccttcttcgtcgattcagcatctgtaatgacaccaagaactacttccacccgttccaaaagtgatgtacatttagccctgctttctgataataacttggactgccgtatatgcctataagcagtttgtttattccctgctttaaaggaagctaatgccatttttcttgaactgcagcaacagcaatgtttcataaggatacaacattttcaaaggttctaaattccaaaggatgttaagcacaaatactgaaatcatggagacccaagtcttcaaagtttttcatcatactttattttaacatagtttcatattttggaatgaacaccttgggcaaatatggagctttgctatccatgaccagaaaagttaaattatacagcatgaataaattgtatttaatacaactgaataagaacaactgtgtattcattaggctgtgaatacacaactacacaggaaccatttatttgaaatatacccaacaactactccatatgccataatatcaaccatgagtctatgactaatatgctctaactcttaccatgcatgctatacagtaaagggctgcaggctgacatgttaaggacaaatacaaccatggcataaaatggacctcttagagaaaaaggatatgaaatttgcattcatatgatatgttcaacaccgaccagattacttgtgttgctagctctcctaaattatacttataaagcagtagacatacagtatatgtcaggcctgttggtttcccaatttctgccatgccactgtcaacaggcattcagaagatgataagaaggtgaaacttagaattgtaactttagcattgtaccagttcctgtctaaaatgctctagcttaggaattactatcaagttcataggacaattacatctcccaacggcgatcaatcacatcaagttgttgctgcaacttttctgttgtccaattcaagtgcaaagcatcatagtcaagccttgagatgctggaaacagatactggcacgagagacagtttgacaccctgaagacagcaactgaactaagtatttgtcctggcaaaaactgtaaaaatcaacataaatgtaatagaactaaaacagaccacaaaacaaatgcattgccatcaaaataacagacaaagatcaaaacagtctacctcaataaaatcttcctttctgatcgagaggtatcgtgccttcccacattcacacagaaaacttaagattgtggcagcttcatcagatcccttgcagatgctctggaacttcccgattgtaataacacaagcagaagtccaatggttctcatttaaaatcttaataatctcagcagctctttcctgcaatttgacatggacagaatctgccaaatgagttggctaaaagccgaaggaaggaaaactgtgaaaataagatttggtatgcacctgaagcaatggccttaagatgagaagatcttcaaagttatcttgtaaagccaatgatctggagatacctatcatgtgtcccactcttctaagcatctgatatagatgcccacttgttggatcaattagatcccctcttaataagatatcaccattgatatgcatttcatgctgacagaggtaaaagaaagatgagaaacaaagcagaaaacttcacattgacgctgaaagcagacatgaagatctcaagcatttattacaaggactgtgaccataacttacaaatcaacatttagaaaaagcaaaacactaccactgatgctactttatacgcatatatagatcacaaattgcatggaagaatttctggtttaattctaaaaataacctgaggattaaccaacatgcctcatccatctacttcagcttggctttaaatccttcattaccattcattttatccaccagctctctacctaacaccaaccctccactttcttcatctgattggtgttgtctatccagtgatcttcagcacacattaaatatatttatggatcacagctgagggtggaaataaaactagagaaaagagaagaagatagatgattaagaagaaactttcagaaagtctagggaagaacatagaaatgagagaaaaaagagcctggcccttaatattttcccaaaacagtatcttaaaacaccacagaaaacagcaaggctattactccttttgaggcttggtcagccacaaacaaattatgcttctaccaggactcttttgaaggaaatagtaattacagaactaccaactaatgctctcgtaaataagtaaactaactagccatgtaaattccctgactgagcccttttgggaccctataatcaatctagaaactttttagaatttagacacataaaacatgatcacatgcaatgttattaaggtgctcgtctaggcgcgcctaggtgctcaagcgaggcgcccttggctgaaagcacctcagcctcctccagacaagcgcctctaccgcctaagcgctcgcttggagcaaggcgcaaggctctcgcctttggcgcccaattaaaattgattttgttctcctggctgttcaatttctaatttaacagctgtaattcactttaatttgaaattacagctgtgggtaatagataaatcctttaaaagaataaaaaaaaggtacttaagtaatttattaaaagaaattaagaaacaaataggttttaaaaagagattaaaaagtcacaactacatgcaccctgtacggctataccccttcaacttccctggactttggacggctagagtagttcccttccctccattgaagttgacagcgcccaagcaaaaaaaaagatatgaattttgttctctttttcacccacttttcacaatttattttctcctctccctctcttaatctcctctccttcttctctatttgtttctattttttattcaataaaacaaagcatgtttgtatttgtcttcaataaaacagttcacaaagcaggtcaacagtgcattggttttacaatggcactatttattctctattcttcttctcttaatctccttctccttctcctttcctgttcgtgactgttttttattcaataaaatagagtatgtttgtattttttttttcaataaaacagttctctgttcatctctgactctctactttgtgcagtcagcagtgcactagttttacaatggcagcagcaaagggtacaacgaccaatgctagcagtaaaaaggaccctggttggaaatataatttcttgaaagatcctaaagatcccaattctgttacatgtatgttctattctaaggtgacaaaaggtgggatatatagggcaaaatagcttcaaatcggaaagtttaaaaatgctaaagcatgtctcaaatgccctgagaatgtgagagaagagctgctgaattacatatccaagagaaagaaccacaaagagaattatcataaagtgccagactttgatgattttgtcaacatgattgagattgaagatgatgacaatgaagctgaaaaccaaacttccagaaaaaggttagcatctggttcagccacgaataaagggatggataatgtcaagaagccatggcataaaggtccaatggattcctttgtgtatcagaagccagagaaagtggttcaacttcgaaagcaaggaaaattgaagcaaacaaacattcaagatgcatgtgacaagaagaaaaaaagaagaagcttgtcaatatattgcttgtctgttctaccaagctggaataccattcaatgttgcaaatttagacacatttaaacatgcagttgaagcaattgggcagtatggtcctaatttaaaacccccaagctaccatgagttaagagtttcactgcttaagaaagaattggcatacacagatgatttgttcaagagtcataaggaagcttgggtaaaacatggatgttctgtgatgtcagatggatggactaatcagagggatcgaagtttaatgaattttctggtgaactaccctgctggatcaatgttcgtaaaatctattgatgcttcatcatatgttacaactggagagaaaatgtttaggttgttagactcttttgtggaacatgtgggaaaggcaaatgttgtccaagtaattaccgataatgcaactaatttcatcatggctggtatgactttctaatcctgatttttaatgccaatattctagatttctagttgtacattgtgatgtataaaagactttctaattctaatttctaattctacattgcaaattgtttttgcatttgtttaaaataggaaagcttttacaagtaaagaggccacatatttattggacaccatgtgcagcacattgcatagatctaatgttggaagatattggggagattccacaagttaaacgaactattgatagaggagttgcacttaccggttttatttttacaaccacgttggtgctctaaacattatgagggagttcacaaaaaggagggacttagttagggctggaaaaatcatattttgcacattatatcttactttgcaaagcattcacaaacaaaaggttaacttgagaacaatgtttacttctcaaggatgggtgtccagcaaatgggtaaaagatcagaagggtaaacggatttcagaaactgttctctcccctattttttggaatggtgtgcatctggttgtgagcgtaattggagtgtgtttgaacaggttagttacttacatcatgtgctgcacatgcaaatcttattaaataatagtaatattatatttttaaacaaattttgataaatgattgattggtacttgcagattcatacaaagagaaggaataggctaaagcaaaagaagcttagtgatttagtgtacgtcaagtacaatcaaaagcttaaagagagatatgatcggtgcaatgttattgatcctatttctttgcaagaaattgatgattgtaatgagtggttgattggaaagtctggcatgcaaggagtcaattctatggatgttaaggatgatttggtgtttgttgatgatgatgacttgacatggggtgcagtagctagggcagcaagtgttagagaaggaaggaaaaatatcaaattgcaagcaagatcaagatcaacagcagcttcaacttcacattcaaagccaccaaacttaaatcatgaagagattcgttctagttcagaagaagagattgaggagaacgtagagaatgacctatctgatgatggaggagatgatcattaatgacaacttaggcataaaatctgatgaagacttttagttttagacttttagaatagaatagtaggctgccttgtgtaagtaatggagaaaacagaaaactcagaaaagttttagtcttttgggtatggtgtttagacaaaaaatcagatgaaaacttttagttttggattagatcattagaacaataggctgtaattaagacttagtttagaatagactatatttattttctatttttcctaaaaacatggcatctgacttcaatcaggttttcgctttttcagcgcctagtacctcaggcgccagactgggtttagcaccttgagggcgtctagcacccttaacaaccttgatcacatgggttcactgcaattctgaaatgtttaaatagcttatccatataagtgaaaaagcttgaacataatttggtttgaacataaacccatatagaaaatgaaaccttcaatgagggaacaatttaagcaatggtactttagtttgtatacaatataatcagtcacatatgtgcctgtgctgaaacaagcacacctgcacacacatgcacccacacacatgcgagaaaacagctcacaatatgggaacaatattaataaatttgtatttgtagcttgcatacatgcataacatccatgtgcatgcgtatgcatgcacacacccacaccaacacgtacacaaagagatatgagaaaagatatactgtattgaatttaaacgtaacagaaattaaaatgatgtattataactaaaataaatatgatgcaagaagaagctcaccaaaaccctatccatgcacaagggggtcagacctccacgagcaaaccaaacattcttgacctatagaaatataaatagaatacttttgagaaaacatgaataaaaagttaagcagtgataaagatttatatgtgcaaagtataaagttttaattttcacatattttcttgtcatgtttgcaacatcaataggatcaaaagcaatcaccaaggtgatgaaaactagggactagccccaacttaaatagatccatgattagacctcccatagcggtccaaacatttacttaagaagcagaccgggtccaatttctcgtacttgctcagtgtgataactttcatgaattgcactgccagttcagtggggctgttggcctaccatgcagttgcccgctgctcctgccacctatctggtaagcagagcaattgttatccttactgttctctctgcttggggccccctcctattgctctagtcatcagctatgacagctccagctcgcacccactacgtaaggccacagtgagcactgtggcctgcctcagaaattagggggtcatattgcaaagtttacaaccatatctcatgctgttatctaggagatgtatggctcataatttctttaagaaaaggtcaaatcataaatcccatcttgttaagaaaaatcatcatacagaatgctttgttcataaagcttgtcatcttctcccagtgttcccgacatggtgcatgcaacatgaaccaaaaggcaaaagtagtttaagtaaaaagaaaacacaatcaaaatgataatttttataaagcaatctcactaactgaatgtaaaacctaataaagacatctcattacatatttgggagtacaacacaaacattgaaaagagggcaaatattttcaatgtatcgcatgaccatgatttcaaattgtaggcaataggcactgtttgttggacatgcacaatgcattcatgcaatatcaatgatgtatgttgttacagtgacattttgtttgccaatcatgcatgttttttttggtcgcaaattatgcatgcttttcggtaatctaattttgttggcatgtagccgatactccaacataagccatcacagtactaagataccgcagtcaacaagacaattgaatatctaaaaacaataactcagtatatttctccaccagtgtatcaccagaagatagatagagttagccagttaaaattgaatttaaattattatggataaaatttttgcagtctaccaagcggcatccatagccactgcccaataacaaatcctctaacataagaatgaaactgcatggctggagtcatatctcacattgaaaaaccaataataagttcttcaccattttaagggtcaaggctttgtgtgggctatgattctaacagcagtcacagaaccgaactcctcttaccaactatcaaccaacaaaaacatagaacatagctgctacaatggtagccgatatattaaaaaacaaattgcttgttaatgaaatcaatcttctcgcagaaagcaacaccccaaataattccaaaaccccaaaactcctagtcagaaaaacctctaaataagtagaaccacaaatgcatccattgtgaatatttaaaaatcaaaacaagcacttctgaaatacaacttgcggaagagaacacatcaagaactatgtaattccagacaaatacctaaaataccaagtaataacaccgagttggatcgaaaccaacaccttgtacctaattgaattacattttaagcaaaattgtgattaaagttatcaatttgtagagagaagatagatataaaccccaaatgaaaaagatttgaggaattcgtaaagcactggcctcggaggatcggacgacgcagaggccgaggctacgagcgaccttgaggatgagatccctccagataaggaagcggtgctcccaatccgaccgctggccgctgaaggccttgaagcgcgcggccgacgccacctcgtcgtcccaatccggcacttctctcctcaccacttcctccaccgccgccgacgaaggaaagggaagaggaggagacgaactactcattcagatcaacccagagaaacctaggatttctaatcgcaggaaatggattgagagagagagacggggactcggggagggaacgagcgttccgcttaaccaattgacgccatcagaaaaattagtgcaatttagcacggtgggtcacaccgatttcaggaacatagctcgtataaggacaaatgagtcgggatttcctcttgatccaagattgaaccagaaggtgtaatctctcaatcatagctacgcattttaaaaccaaagggcctcgacttagaacaatcaaggggttagattaggacttgaccgaacttgacccaacccggtctccgaacttttgctacgagaaaagttggaaaccagcatgctctcatcccgccctccctgactcccctgcccttttcttcattgtttctaattaggtctgtcgatttgagttgggccgttaggttggcccgtcccaccatataaataaaatagattgagttcatattttaacaatccatttaaaaacaggtcaaataatccatcccatttgggttggcaaattgaaagaggtcggggcaggttgggacgagctggttcacctattttgtttagtaaaaaaaatattaccaaatctccttgaggctttgatccttatctagttatccacctattttgtttagtaaaaaattacaaaccctccaaagattgtggagaagatgggagaggagagaaaagagttaacagttttttttttttgaggggagaaattttggcgagttggctcatttaacccgcagaccatgacggatcggatcgggttggagtttttccaacccaccaattaaacggatcagcctgccctaccccgtttagaagtgggtcggggtggatcggtccgtcttgacagctctatctctaatatagaattagaaggttcatcagacctttcatggatcacttggacgaggtttggcaataagatctattacatccaaaacttaattataaaatgaaactcaaaaagccataacttatattttgaaaggatttggtaagcttgatgtacaaatcgaggactaacttctaataaaatctagaaatttttatgatatcttctatttttaaaaaatttagcctgaactataagagggatctatttcttaaaaaaatagatttcaatcgtataaatagagtttgtatcacaattttgtacataagaatgaaaataaaaaagattttatcctactttctgcctaatctctcttttaaatagaagagaaatccatcacaattataaaatcatggacctttctaatataaatagaacgtgtaacaaatttctctatctttaatgaaaataaatggcttaaaaccctgcttttaaaaaatatcttatttatttattattttgagagctctatattaagatggttgaaagaaattcttgctttgatcaagttcgtattagaattttagtccttaaatatacgaggcattagtctcgactcgagagtattacaagcaaataggaaaatcattatcaagtgtattaaagagtaaaagcaaatgtagccattgcttttgcctcatcaagtagcgatgtgaagaatgccttacacaattggatgagaagaccacctaactcactgttcttatatcttagttagcaataccttcaactcaagcactagttactcctattacatagttcttcgtttataaaaaagatgaataattgtcaagagaggaggataagcaacttataggtactcaaaatttccctcttcagctcttttaagttaaagcttgcaatgagatttgtgttcaactcttcgatataaagaatttcagtcttgtaactgaactgctagtttccttggtgacttttcacattccatgatatctagaaatttgctgacttcataatcaactccaaaagaaatatcacttgtcaggcttctaaaactgccatcagctctacagcttaaatgaaaatgtcacttggcaccaggtatgagagatgtgaatgatccttgatcttgactatcacctagaatgctaaaatacaactcgttaatataattttatatagcctaaggaactggaaattacaatctttacctaggaagagggatgtgtctcttgtgacttggagaaggtattgaaaataacaatattttccaaatcagggtgatatatctgagattcattacttggagttgaccaagccttccctcctgccacatagccttgcaggttttatggcaggccctccatttaagtgcgatgcattggctgtaatcccgcaacattttgaagattgatgttgagaggcaatactacaatgttcccaaactttggtggctcattttcccttttgctgacacataagaggtagataattataaggcctgtaggttaggatcatcgctattaaatagataaacttggatccagaacctgatgatacatatactcgcctgagatgggcatatttggtatctatattagactcaccatttacaccaaaaaaaaatagaaggaaaaagaaaactatatcaggccatggaggtgagacatgcctaaatgcctatgaaaaataaaaccactcgatcctcattcaccaaccacttcatgatcaaaaattaagttcctttcatattcccaggcataatcctagtccctgaattaactttttgtcctaaatatatccatatggcattaatggagggtgaagattgccttctaaacaaaaaaaaaaaaaaggaaaaagaaacctacaataatctaacagaaggttatcttcttctttgggtggtaaatagcccatttttctcctatactcgtagccattgggttgcatgtcattcttggacataggtcttacaaacagccagtcacctcggatgctgaaaaagcttctaccctaaaaaggacaagtttaagttttctctggtagaaaattattgagttttgatttaatggcggccatatgaccatggtttgcaaatgatctgaataagagcaaacaggtcaaaagttcttatttaagcggtaacaaggtgcagaatggcagcaacagcagaatcaaatttcgaagtctttctggtgccagtccgattcaaagagatagattaattaatctgcccgcatgacaaccttaatttgtcttgtttccctctctttttcctaagcctttagttttgcatatggcatctgaattaaataatcatcatgatttgaatgtcaaaatcacgctcctattttcttttcttttaaaggctaccatgtgctttctttttgaaggctagcaatgatgtacaagcacaacctttctaatgatgtagaataccaagtcttgcagtaaaaatgaacatgtatatatccacatgatgcacatgagaatggcatgaatgtagaaaacaatcatcaagtccactgatgtaacctaactgaaaaatgaaagaaaattcagctgccattaaaaatatgtatctatgataactcaagcaacatgcttactatagtagggtaaaacagacatttgcctgctcaaaaattcatcacctaaacattatgagaaataaaattatttagtacattatccatatagccctatttcaaaggtagagtagagcaagacttcaaagagcaactagcaaaaacatattttaagttacaaactataagtagaatcacacacatcacatgatcaaccaaaagaattctatacatacaggcaaaaatatcacaaggcaaatacaagcatacatactgaaagaaaaataacaacaatacaaagagatattccattttatatcttcacaggtatcgagcaaagaccaagacctcttgtgaatccttccctgcatgtgacttggttgctgaagtagaaatcctcttgaattgccatctaatcttctatatacacatgcactagttacactgcactttcttctgcagaaacattggcataggcaggatgccaacatatgcaaggatgagctttatagcatagaaaaacaaatatattaaaatcttatattaaaagccaatctgcatctacacctcctctccgctctattttttttcaactgttgaaatgagctgtagatctctgtaattgggaatgtaatcttcctaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttcctctatctcttcttccgtctctgtttttcaacattaactcatcttttcctttagatgacattggtctttgaactgggtgatttcccaacaattgccttcttcactttaacaattgacagcttcacctttgatattatgttatttgactggcgttgagatgtcttatctataaccttttgttcaggagcctttacatctgtccttgtatcaccaccttctttggtgggttcaactgaactttgatcatcagccttcacaatctcttccttgttgtctgctgaaccttcggtcttaatggtctgcatggcttttgctggcttcaattctgacttggcctccttagagtcatgttctagttctctaacagatgcattaacattgctttcccctccaaccacatcaaggtccctggaggtctctatgaaagttgcatcgtccccctaaaaactttcatcttttttctccttgaccacctcaacatctcctaaagccttttcttgcctagagacttcaacaacttcagcagcatcatatcttctggttttctcacttaaagttggctttttgaactcagtcttttctggcttctcttcttcaaccttagcttcgggcttcccagcctgttcagcaacttgagtagctgaggtggtatgaatagcctcaaccttaattgcagtagaaccaccttctccatccataaattcctccatacctgcatcagcattgggatcaaaatctctcttttctattacatcaggaactaaagctcctacctgaacttccttaagctcattaacttccacactggggattataatggcatcaggtgtagactccaatacagtaaatgttgttgaaggtcccactgatgttgaacttggtgcagcagaaactactggagcttcttccttactttcaatttcttcaactgttggctcttttattgcttcaggttctttttcttgcattttagatgcctctgtatcctctgctggtttttctacagcctcagttggtggctcagaagtatcagttgcattaacttggttctctacttcaacctcaactgatggtgttgcagtagacttatcatcttcttctgtttttacttgttcagccacggtgacattttctttatctcctggccttttatctgattctgttatagatgcttcaacattttgtgaaccctccactttgatcttttctcccttacgtgtttctttaacatccttggatttagaaacattcatttcatgaacattttttatatcatcatctgctttcatcgaatcaatatgctgcggaagttttaagccagttagcaaacaaccaaaacctcacacacacacacacccccaaagagaaagaacattaggtccacaattatcaacccaattcatattataatctgtctagtaaattagtaaagtttgcttctaaaataccattaaacttaattaataaaaaaataataaatttgaccaacagctgttagctcaactggtaggtacacatatctcgaagttgagtggtggcaaaataaccataatcatttcagatacaatattatttccactctttatataaattcacctaaagacaaaaaacatcttttttcactgttaatatacaaaacactcgtcctactgcctcactgcagatcccaagtagcttatcattcacatattgtataaaaattttatcctgaaaaattgaaatcttttcatagatgtattagagcttctgctttctaataatacagtcaccaccacgagctagtattaatagaagtattaaattctaaaaatgtttaagacaacaaaatcatattttgcttccttgtccagtccactgcaactagatgaaatacagcaattttcccggctgatttaaagcatgctgtcattagttcaacttcaaagatttgcaaaaaaagtatctgaattttaaggttttctgaagtcttaacatgactttggaagaaagtatattagatgttgggctacttctgcatgaaagttcttcgatcaacaaaaggaagaaatgagttcgagcaggcatatgcccatcctatttccttgaaaaggaaaaggaaaaggaaagaaaagaaacaagaaaagaagacgcataagtggtaataaatcattattatgagtggcagaactttacaaaaacgagttctaagaaagaaaagaagttcaaaacaaaatactaagaaattaagacattaatatggtaaggcactaaagctagactagcttagaatagatgcatttgatatgaagtgaagttgaatcttgggaaagagggcctttcacaatatccctcttcatgctaataaaaataactattccttttgtttcatattcttctttctttgttccaaactctgagctatattggatacttgttttgttattcgctgtatgttcccaagggaacttggtctctgtttgtttcacatacgctaaaacaaaatagggtcaatctgccaacttttttgctcaaaaataaatattccaaaagataatcaggttagacatgtgaaatatctttttcatgattcactagcctatccactacaaagatgcaaagacaagttgctgtcagccaacaaaaaaggaataagaaaggcaaaatataagaaggcaaaaaaaaaaaaagaatcagagattgcactttagagttagcataatgaaaatctccataggttagacatgacagattaaagcaaaaatatgtgagactagttttatcagatattgtcgccagggtcaaagcataaagaagataaataaaaaataataataaaaataaatacaagagacatcactgagactattagaggcttgagtccatcatacgacacaactgcagcctgctggctgctactctgaatagcaataacaagggggggaattttgaagccaacctaagagtgtcgtgccttagatcattaacaagtgaaaaatcattaatcttttcttactttcttaggctaaactcatgaaattcttatttctgtgattcgtgactgccagattccacatcacatttgcatagcttgataaaaggaagaaatatgcaggtcgaacaagtagcccattagaagcaagaaaaataaaagagtattttggccatctgaagtaggtaatgcttcaaaccccaacttccaccactaaatcacaagaagctaggatctgtttctctcagttgtcctttacatgacaaataatgatagaataagaaaggaaagaaaaagaagagggaacagcaggcaaattcatttgtctgtgattgattagccttttgtgacaaaaaatatagatcatggtatgattagcccacctgcattttccattatcttgctgtgcatgtgtggtgggcactagtggcatgacatgattggccatgcactggagatatgggtggcaattctttaaggtctattagggttgctttcagctgtgctttatcagaggcttcaaacctttagcaaaacctgagggtactttcactttacatggtccccccaaatgttgtaggctgctttccagatttccaactcttctgtcagcattttgtggataagtaacaaaatcaagtcggctggaatctgcttgtgatgaccatatggtggaagatctagttagagaggaagtgcaggatttttgaaactacttctcatcacactgaggctttaatggaacaaactaaaatttggcttgggcggaatggtcttcgatccattgctcctatcaaattttcttatgagttaaaaacacttgtatctcaagtcggctggcgttagtcttgttcattttaataattcaatctctcaatgaaatgaagaaattgagaaacacattttcttctcaaaaacaaagtcaagtcatcgaatgaaaatctcataaatttcccaatgtcacagcacaaaaccctggtttaatattactagttccttgcttttaatcaaatcatgcatggtcagaaaccataaaaattggctacattactgcatttgagaagtcacgacttatctccggaaacaatgtagttggatgcatcgagaatttcaattcgaaaaacatagctcaagtaatcgatcatttccgatctcaacattttaagggattctagtgtattataatctgctttcaactggatgattttcaacactcaatgcatcacaaagtagttttcacaagcaaaatccagaaggcttgggcagcacatcatgaagtttgaggttgcaaatgtagatacgagtgagaagaggaaggtgaatgaaaaagattgatatcgttggtttctttttctaacacatgatgcccgccaccccccccacccacgcgcacacacacaaacacccaccaaaaaaagaagaagaagaaaaaaaaaagagaaatctttttaattaaaagaatgctccggatcatgaattatgaggacaaacatggctttaattttcaagttttggttcgaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtaatagaaatttctgtccgataattattaaaatttattattaaatatataataaaaattttactatagaaatttttatttattataatttaaaattatgctattattatgtgcccatcaccagagctggaccccagtcatcaacgagcgagtgcattttcgggataccatccgctcaagctaagggcttgcgggacgaaggggatcatcgatcccgtctttgttccaactcctcgtccatctcggatcgttcaaagaagaggaggaaggcgaaccagaagggaagacgtcgtccgattctcaaggcggaggaagagtgaaagaagtccagaggggagcaacgatgggcgcagtgaagaaggcggcggaggtggccgcgaaggtgatcgatcggaatgggatgatggcaaggcttatcgcctccaaggaggccctccgacccaagctcggccaggtatcaaactacgtctctctctctctctctctctttctggaccgatcgatagatttcatttctgcttttgattcgaaatgaagtggaatgagtgtccaagaaattaaaatttaagacggctttttctttagatagataggaaaggcttgggctcaactgatctgatttcaacactgagctttcatttttttcttttccccaaatctcacaatgtcttatgtgaaaaactctttgacgagattctggagatgatgattttttttccttttttcccttttaagtcctgtgcagctgtgctgaagattggaatgggaaaagaaaaagttatttcgatctttttgatttgatcagcacagcgatccgtcagtgaaaactcgattatgtcttatttgcttttcataaatggttattctagctcagaagctgaaatcctgtaacctcgcataccttcaaacactctgctccctgcaaatatcactctgtacatattcactgacgtagcattggcgaataaacaagaattcacaccagatgaaaaccttcaagataacaaggaagaatcctagactccaaatggagaaaataatctggcgatttttattgataatgatcgaataaacacaaaacaaacgtatttatagtgtctcaaccctaatatggatagttgaaaattaaataaaagctaagaatacggaactaaaccaaagatagactcctaaacagaaaacggccttgaaacccactaaaatgatggattttgggccctaaaactaaggtgaataggtaaacatggttcataatcatagggctcggaacgagctttccattgatatattatgggtccgtaactcttcttagattaaaagttgcggccatttgaagcttaggtccatgttttgactctccaacccttttgtttgggctttcgttgcttcctgcgatccatttggcccaagtactcttcagccagatgttccgtgtcattcactttaataaaagttggatggctttttagcttccctattcatcgtcaaaaaaaaagaagaaagaaatccccatgctgcctaggtttgtagctatattcttagtggccatgatagtcatagctatcaaaactgaccagaattttctttttgaggtctgcaacatatgtaacaaaaaaacctcaccccaaaaggctagctggacggtttttttgggtttccttgtaccaagatctatctcatgcatagcaaatgtggcactaaatatgtttgtatgggttctcacatactttccctatttaagctctagcattcttgtgaggctaaggatctaaatccatttcgatataatcacaactacgacatacctaatcacaaacaccataaatttgtttagtgttgctatctaggatttaccccttaattgtctagagcactagtcgtgggaggaagaggtctgtagggcaccatgttgactccttgaatctggcaagggccatctttcccttttaggtccggtttctaaggagaggccagggatggaggatggttgtggaaatttgacatgtcaatcccgagcatgtaacttccggattgaagctccactttccccttctaatgcgacttttgagatgtggctaaagaagggaggggcttggctcaacactttgatttccttcacggaccatctgatgatgggatggaacctagagggttggaatcaaatgacctaggtgatatgggcttaaatgatccaacctaattatagttccaatatgcttgattggtgagctttgctttgagcaagttggacttggtggactattttgcacttaggctccgtggtgagctaagtgatctggcttgtggagcaggcctgagtcgcttcttgggtctgtaagctgaataggcctccatttggatgcttgcaatgctagctatggctcgccaattgcatgggtccttggccttccattagcgaccttggctctagaaggatcctgaactaagtgccctagttggcttgaaatacagtgccactactgggatgtgtcaaccttatgctgcacttgatctggggatttgctcctagcatacttagctggtttctgcagccattcaagcttggtgggaaacttggtgaaaatggatgagtgaggcatataggttaactcaccttcttccttccaaacaccggaatgtttgctctaggcctgttgttcctaattggtactagctagggaccaaacaagggtcggtgattgatagttccttgctccctattatccctacctagttgaggcttcgaacttgctttggtttgtactagtataatggccattggaagaagtaatagagtgatagatctcaatgctctattccaccatgacaaagtttccccactttagagttttggtaacatgaggagtaggtaggactagtgctgggaactggaactcctcatcctgctggccaatttgtgtgcatcaaaaacaaaccatcagcgcattctcataaataagttgttgccagaatattttatacttaatttgaatcaatcaaccaggcttcaagtgcgaagtaatatccaccctcaggcattcttgagcaaaatgacccttcttagataatcgatgatatcatttataaacatgggttggtgcagttgaaacaatacttaggatcgtaaatttttacttccaatactctttcgatagcttgggaagcctcatccatgagggttcatgcactagcacctagttggtgatcaaccaggggcccttcattagaagcacttgaatagatagtggtcctctgcaatcatgaaggcatacacatcattcaatatctttctcctttgtttgagttccttggctttaaatttcatgtgtattctttgtctcaaactcttgaccgctaccattgtggattccaattcccattgagcttcctccatcccttctttaggtagcaccaacacattggcatagtggctctgtaaggtagcactttcctcagaaattctatgggtgtgccaaagtgattgctgttgctaaccctggactgcattcatccaagagagccccttctcctcatctccatggttggatgcctcctctcccatagagccagccattggtggtgatgctgagaggatattgctatatttgctggtgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatataaccttttgtttcacattttagccaatttggatcgattatagccagatacaattggtgtgaatccagctttcattagtttgactggttttaagtagtgttcccttcaaaaaggctggtctaggtggactcagtcagagatgatcaggactggttgtggatgctatatttattatttggaactttagcgtaattttgaatcatttctttatttcttcaactctagggtcatttttcgttagagctagaacaagaggtttttgagtcacatattagcatttcttgtctatgttaattagttgttctagtaaaattttgtattttctaaaacttatcaattgtacactggatgctatttgtaactatgtttaaatcttatgagccaggtcttctacttagagtggcttacccacttcaaaaacttgtcgctgcactaatttctaagtgttcttctattctagattgttttgagtggttgctcctgcatgctagcacccaagtccactctcacacttgctcccccttttgacatctaaggtatatttaatcaaataggcatatatcctcctatattcttgagaaatattaataaatgaacagaagggctgcctcaatatgctttaatttccaattatttgaaaatattggatcactgaatgaaaactatgtgtatatgcaatatagatgaattgtttctttttcaaaattttgactatcaattgtctaagactactatggtgcctactcatgagtgaaaactctagacttaaaatgtccactcctgccacccacccccttcccccaacccctgcttggggcagcttttgagaagattggaagcaattatgagtttggctttaagatatataaaccatactcttctttttaaagtgtgctccttttatctgggaaaagaattgtatgcaaatttatgtctgctcattctctcttatatatgatgacatagttttctatttgataattagattattaccaaatattgaaacatgtgaataatattttacactttgagttgatagtataatattttaaattgatgagtataatgttttcattgattttcagcattattttaattttcctagatttcgtatgcaattggtaaatggtgaaataagataaagtcaattgttccaacaatttaaaatactctaaaaatttgtaatataggtagtctcttggcttgccttattttgtccttttgtcgatggcatatttctttaattttgtgacaaaaactccataacttggatcaaatatggtgggccaaattaaaactgaaactgagctttcaaacattcatggtcatccactaaggactggctaaacctaggtccttcaagattttagacattaattggatgtggaattgaaatagctgcgggcttaaggtacatacttaactcaaaatgggacgaccttaactttatgttacatctaagacagagttcttggggtctaggatttcaattcagattaatataaaatcaagtaaatgaagtttaactagagttttgtacaattgatatccaacttattccaatttggatatagatctaacatctaaggcttggggttgatctacaattttttggatacaaaaactgaatggggaaaagctagctgcagcagccagctagcttgaatctctctctctccctctctctcttactttcattccctccctctctccctcccctccacccccaaaaccaacaatttactaaaggtagagaagaatatgacttccaatgctccaaaggtaaggtaatttgaaatatgataatggactagttaaggcattcggataaaattatggcattagaataccatggagttagaaatctagttccatatgtattatttaaagaccttaaaagaaaattgagatacccatggaggacatatcctcttgataagaagttgaaccaattatctattttcccctgtatgataataatgcaaaaggataacaagtgtctaatatcatcatatccttattgttttattcgaggatttaaatgtctgtcagcctccaaaacatggtattttggttcacctttattggtaagagaagtttagactttagagtaggaagttgattatctggctacttatcactgttggtctcttcagttactggccagttgcattctttctttacgaatattccaatgggcaactattgtctttaccaagtacaaaaaagagttggttcagaagatccgccttggccactgttgttggatgcaatatgggggagaactatcagtaatactatgtggagccaagagtagaagatgtatggagagaactttaggtgcctagattctagatatattttcattaacaggaaaatggtgcaacacttggtaattcaatgtctataagtttatatccagtgattcgaccatatcattatgaatgaccctagtgcgattctattttaagattttaaataacccacagtgaagcttttagatctattaaacttggtgaaaacagtggaggataacaacatatgatatacaagataaatatgggtttaatcagtgaaagtttgaattatacaggtttgatcaaaatatattccatttaatcattttctaccattcttatagaaaaatttttaaacagattgtacataaaggcataatgtaaaatatagttatggtgtgtggatgaattgcatagatgctcttgtgtttctttgtgattattgcatctccctccctcccttcctcaggggaaaaagtcaaaaaaggtacagtaagtcaaaggaggtatggagtatgaacatagcaacattcaatactaattcattaattgatgtcatctgttgtaattaagcatgatgcaaaacattgaggcagggctaggttgctgtttcttgaaagcattaattatagggtttgtgtgagtctgtacatgcaatcacatacatatgtattatgtatgcatgcacatatctttctgctgaatagttttaatattttcattttagcactctctctgtggacaataggtgacatcacagtggttgggcacttgttttctgtctagaagcattccattgcctagacagctgatatataggattattgggtatccatgctagtgacagactgagaagatatagcacttgtgcaagtttgtctgaaaattctgaaatataattttttttatttgtgtttttacaatattttgagaacttaattgattatgagtatctcgtactacatctacatgtatgggttatggtttgctaaagtctgacataaggtatgctttattactttatctccaattcagtaataatactgaggaaagaaatgttttgtggacaatctagaagaggcagattgtagcgtctttgtgtaagtaggacctagttgttgagaaattgagatggttctcacttaataattaagtgtgaggagacctatgccatcttaattatatcatttacagagagattttcttgcattaaggcatgaagcaaactattgataaaatctgcatgtacatcatggcacctcgagtataaggattgagaagaagcttgaatctactgcaaatgggcaaaaattgatccatcattgtcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctccgaccgtaagtcggtcggtcggtccctccggccatcgatcggtcgatcggtgggtattccccaacaatagtttttttttttcattttgagagatcattcatttctgctaagactatatatataaatagagaaaaatgatggatcttgctcttctctagaggagagtatgtctattcctcttgagcccaatatcaataatagggcatctaactcaaagatccacttttcgtcataatatatatcactaaaaatatctagaaatcaaaaatcaagtgttttaataatctttgctcatgcatcaagtgagtgcaaaaataatctctgatcatgcatctagtgagtgcaaaaatgaagggttaagataatatgagatcatattttgttatgatctaaaaaataaatatatgatttttttatctttatatatatttaatatgtataaattgtgattgatataagatggatttgaatttaaatactttattatatattttagcatactaacataatgaaaactatttcattttttgtgccgatacggtatatatgggttactaattaataaaatatgtgatatttgatttcttggcttttagtggtttagattatgctcaaccatatgaatttcaatttaaatgctatattattaattttgaactcgaaaggagaagattccctctcctcttgagaggagcaaagctatctcatgtacataagaaggattttgcccctttcagtataagaagatatctattctttttgagttctaatcaataatgagaaattcaaattaaagattcatatgttatggataaaaccttggtgcccggctccgaaaacatgtgtaaactctgattgtgactgacctacacatcgatcgtcgatccgtacatagggttctgatctcatggtccatattttcaaaagctgtcaattcacttttgagctgccaaccctagcatctgtgtctgatcccatctctaagagaaacgggttaccaatctacgtcttgaccatcgcctcatcactaatggtctccagatgtcgaacatcaatctaaatttttagttctgactcccatatcagcttcgatcctaatatttattattagagatgtctgatcaggataccacctctacaagaccttttcgataccacgcatcacagcagaaagaaaaaagaaataaactggaaacaatcaaatacgtggatcaactaaaaaaaagctcgctttcgcgggacatgcaagcttcactatgagaaaagagaaaaattataagaggagatcacaccctcaatcctcatacacccaatctctccctcacaaaaaaattttcttcacaaaagctctctctctaggaagatcctcctgaacccttaaattaatcgatgttcgctgtctgacagtttgtctgaagcatcctatagttctactttctgttagctaccgctgccctctgctccacggtttaggtctccacagaaccaccatacccatctctattgccacagggtgagtttataagcctcggaacccaaatcggatcgaaaactgactcctatttatgtcaaactgcctctctagccgccagatcaagatcgactcctgtcataaccatccgattgtgcaacatgagtcttcgatccacaaaaattcttgtagattgtgagaaactagtctgaaatgcccttcgatccatgatggactgcattaaaataaggaaaaatgcccgttcggtccatgcgggtccccatggaccatcgatgggccattgaaagtcgcatgggccgtacctgtgcatgctcgcttgggtctgggccgtgccttgcgtgcgcccgcccgtctgtgtgctcgcgatcatccggtgcaccgctgcacgcatccgctccgccagcttgctaccgaccactgtcggcctccatctctccgttagccgtgccatcttctatcgagcgtatctccttcattcgatctctgtttggattgatcttaagctcgttggactccattcatcattgcagtcctcactgtaggttcagtgtagatcaaatctcgagacatcaaatcttaataatctctactttgactcgacattcgatctcctattaattctgagagcttctggatctcctcgctctctactctggggcaattacttgctgatcatggatggacagacatggaagtcgagccatgccactcgatcctatctctatcatatgctgtgttcttcttgatatgaaatctgctcgagttatcatcctatggcaataagaatctcatcctgtgatatcgcctctcattctctcgagtctcacatctcatgtctgatccacctccacctagagctctacctcactctggactctttttggctcctgaagcttcacctcacactgagctcttcgtcaggtagtaatattctctcgttctcttttttttcttcagaataatcctatcaccctgcaacaccttcaggattcctccatcagctaccatcctgtagcatctagaattcagtttgcttagtgagataagattctacctaaaatcggatatgcatcggacctcccctaatctcctcacagtgccatcatgtatcctccagttgatcgtctcgatgcttctgatcgcatagttcaatccattcgacagacaaacagtacctcattgctctttagggagtcaaactactcctctctgtaacatacataatagatgcatgcagaatctaaaattcactactggaaagaagtagatacctcgtcagatatctccagaacatcaccctctgactcactactggtcgacgttgcagtagctcttgtctgatccctgagttgagagcaatctctggctagatgtcccaacttgtcacaccaataacatttggtcttactcaagtcctttgtcctggacctgaaccccccatcgtgatctcctatcgctctgtctaccatctcctactcctccagaaactaccaaagctgagctgccatctgagcttgaagctgggttctcccttcagaaaatcttgttctgaagaatcaccatagtgaccttgtccatcttgatgatattcttccccataagaagagtaatcaccaagaacttatacgaagaaagaagcgatgctagcaagaccagcaccatgatcttcgcctcaactttcttgccaatgctaaagaggtcggtgagaatcttctagaagtggctgagatactcctgcatgctctgtctctcagtcattcgtagttggtagaactgcctctagaggaagatgatattagtgagagacttcaccatgtacaactcttcgagctttgaccatagcactatcggagaagtctcaccaagcacatgaatcaccacctcattgctaggtacaggaagatcgtacccaccatccacatttggagccgtctccaatcctgcaccttcgtggtagttggcttctcctcgcataagagagcatcgatcaatccttgctggataagcacgtccttcacctttacctgtcacaaggagaaattgctctttccatcaaatctgttaatctccatcttgattggtcctgtcttctctatcttcaatcttgctctccactgtcgcaattcgtattttgatactacctagctttgataccatttgttgaggatgtctagccaagacaccacctccacaagacttttttgataccacgcatcgcagcagaaagaaaaaaaaataaaacagaaacaatcaaatatatggatcagcaaaaaaaagttcgcttttatgaggtatacaagcttcactatgagaaaaaaaaaaattataagagaagatcacatcctcaaccctcgtacacccaatctctttctcacaaaaagctcttcctcataaatgctctctctagaaagatcccctgaacccctaactgttgtctgctatctgacagtctgcccaaagcaccctatagttctgctctccgttggccgctgctatcctctactccacgatttcaggtctctacagaaccaccatacctgtctctgttgccacaggatgagtttacaggcctcggaacccaaactagattggaaactgactcttgtttgtgtcaaactgcctctccagtcgctagatcaagatcgattcccgtcttaaccgtctgatcgtgcaacatgagttctcgatccatgaaaatctttgtagactgtgaaaaatcagcccaaaacatccttcgatccatgatggactgtgtgaaactaagaaaaaatgcccacccagtccatgcaggtccctatggatcgtcggtctacacatcgcacgtggaccgcgtgggaaaatcgtgcaggctatgcatgcgcacgccctcctgggcctgggccatgctcgtgcacgtgcccgcacatctgtgcgctcacgactgtctcacacaccgccgcatgcgctcgctccgcctgtatgccgccgctcaccgccggcctccatcgctccgtaagtcatgccatcttctatgtagcatatctttttcatccgatctctgtttggactgatcttgggctcattggactccattcatcatcgtgaacctcacgtggactcagtgtggatcaaatcttgaggcaacaaatcctaacatctaccatcgatccttatcttcaacagtacatggagcaagctatgaagccacgctctttttgacctccattttgatcaccatatttgaaaaatttgacaaaaaatcctaatacagtcccgtcagatcaggctaccactggaggcaactggatatggatcagataagacaactgcaactactttgtacccagaaatcaagccgaagatagcgggatagcgcatccaaaggagtcgaagcaatctccaattcctctctcccatggctctgacctctatggtcgcatttgatgatctcaataagatcaccatggtgatataagatcaccagtgatctaaatcgtgaggtaatatgatcaccagtgatctaagatcactatgtttggtaggttatggtccaataattaaagattctcagatatccatgagtaacctatttggtattttatgaaaatccaagatcactaattatataataccaaaatatcgataatatatcccatagatatatatttattaataatatataattattataaataaaatattattatatttattaatatattaataattagtagattctataaaaatatatttattacttctacaaattattaatcttataaacatatattaattatttatgtatacttataatatattatttattaatatgaatatttattttgaatagaaaaacatggcaaatggaagtagtatattatatatatttattttataaatataaattataataagatatttttactctaatttaaaattaacattgaattataatgtgataataatataattaataatatattataatataatatatatcataattataatatataatatcaaaaataatataatattatttatagtattgatataatatattaatggtatattaatataccaatttttttattagactgagagggggcgtttggtatggggtggtctattcaagatcaaggatgatatatatggagctgatgaaatcatcatatttgattgtatcataataattctatgtggcagagatttcaaatcacccacatctctcaaatcatctcccaacccaatgataggatatccatccttatggtccgaaattcaagataccccccgagcagtgatatggggctaaaatataaggacaaaattattcctcaatctaacaaaaaaagatacatcaatataccattaacatattatattaatattataatatataatatcatataataataattaatatatttttataagattaataatttatagtactagtaaatatatttttatagaatctattaattattaatatattaataaatataatcatattttatttataatatataatatatgattaataaatatatttttatggaatatattataagtagtgttggtattgtataaccagtgatcttgaattctaattaaaacaaaacaggttactcgtggatatccgaagatctttaattactgaaccatcgtctatcaaatacagtgattttatatcattgatgattcgatgagtataaaattcagatcatcggtgatcttagatcactatgatgatcctatttggatcatcaaagactatctgagggatattttttatccttattgtaaagaacaatagaaagagaaaagatatatatatatatatatatataggttatgtaaaaaaaaattattgtgttattcttttatgttacaggaggctctatatatagagtaataaagatctaaatacaatgatctgtctagattcaatgaaccatataatagaggtctagatttgatgaaccatctaaatacaatgaaccatagaagtctagatacaaagaaccatctagataaaatgaactattaatctcctaattgatatcttttctaaacaacattatacaccataatgtataccataattgatctctaacactcctcctcaagttgaagcatagatattaatcatatccaatctattacaaatgtagtcaatcctattccggtttagagccttagtaaaaatatctactagttgttctccagttctcacatgtttgacagggtcaaggccttgttcgatcttctcacgaacaaagtgacaatcaacttcaatatactttatcctttaatgaaacacagggttagaagcaatatgtattgtagcctgattatcacatcacagtctcataggcagagtacttttgaaaacaagctcatcaaacaaatgacaaatccatatcaacccacatgtggtttgttccatagctcaatactctaactctacattgaatcgatctaccatagtttgcttcttactttttcaaaaaatcagattaccactagcaaaaacacaataacctgaagtggacctttgatctataatagaacctacccaatcagcatcagagaaaacttcaacttcatagtggctatgattcctatacaagatatctcaccctaatgctccttttagatatgttaatatatacagaactgcctcccagtgagtagttcgaggaaaaaatataaactggctgaccacactcatagaaaaggcaatgtcaggatgagtgactgtaagataattaagcttaccgatcaactttctgtatctttatgggtcttggagaacttctccattatctaccatgagtttcacattaggtatcatgggagtttcacatggtttagctctcaacatatcggtctccttaagtaaatctaggatatactccctttgtgaaagaaagatacccttcttacttcgagcaacctcaatttctaaaaaatattttagagtacccagatcttttgtttgaaattatgtctggaggaaagacttgagatcattgatcccagtatcatcacttcctgtgactagttacaatatcatccacatgcacaataagcataatacaaccgtcacttgaccgccaatgaaagattgatgatcaaaattatttcactacaatccaaactgcaacactgcctaactaaaatggacaaaccatgctcgtggacattgttttagcccatatatacaatgacttcttgaagctacatactttcccactctattcttgagcaacaaagtctggtagttgctccatataaacttcgtcttgtaagtccccatgcaagaacgtattcttgacatttaactgatacagtggctgttaataagtagctgcaagtaaaataaatagtttaacagaagtaagtttagcaacatgagaaaaaatatcagaataatccgctccatacatctggatatagtctttggcaactagatgatcattcaaacaagcaacagaaccatcaggattaacttttacaatataaatctatttatatctaatagccttcttactactagataaagaaaccaaatcccaagtttgatttcgctcaagtacagtcatctcctcaacaatggatgcacgccatctagcatgggatagtacctcaatgatactagtaggagtcattatggaatcaaaagaagccacaaaagactgagttgatagagataagtcatgattataagagacaaataaaaaaatggggtaggtactgttgaaaattgtgtcccaaagctaatcgtcaatctgttaacggttgagctcattattgtaattgtatatgaattgttaaataataaatattatttaattttttcattacgttgtacatcttctttgcactcttgtacagtgatgaagtccttaggactattgggatcgatataagaggatatattgtttaacccttaaacctagttcacgatcaaatgatacgctattattaggacgatagctatatcaagtgtaggtcattgtgtgtaatgaacgttggttgtcctcttaaccaagaagtgtggagacactgacatggcatgcaagtgagatgtagatgtacatctcattgaacgtaaccaactgcagagcactctgctgtcaagagtagctcgtgaaggatatggatataaatatttctccaatctgagatcactatgatgacttgcaagtaactcactatgctttgatactggattacttaaatttttaattcaataataaaaaatttttggacacagtcaagtacttacaaagtcggtgtgtgagtcaaaatggaattgacccatctaaataagtaggagttaatgcatcaatgtatttcaattcagtaaaacctcgattgggataatctatgtgatggatttaaaaagttgaaatacaatgtagataattttttttagattggcagtaaaattctaggtcaccttgagcattaggatcaaaagactaaattatacgataaccatatgccaacgagtattgtttagcaatttttcaatctatccgaatgtcgggtatcattgatagatgatcactttgattgatataaaaaaattatttttgtactactgacttaggtttaaacctatagggtcacacttaaaaaaagtttctgactgatcatgtagctgatcgatgattgagaatcatttcaggatataaccgtcatttcgattgatgattaaccttgcataaaagttgtaataaattaattcactaatgattgatgaaatatagaaggagtgattagcaattagattgctaattaattaaatttgattgagcattaagatttggatcaaatttaattgaattagattcaatttggtttgacctgattaggttataagatgacctaatcgctaagagtgtttaatttctgatttgatcgaaacttgaatttgattaatttttaatttgattaaaatttaattaaaataatttattatctaattaaattaggttcaatggtctgaatgggtacaacctaatttagtttgtttgagaacctaattggataaaattcaagttcaaatgaatttgaaccaaagcccatgcgccaccctatctctgcacccttcttttcttcatgtgagaaatatttctacatgaatgtttctcatgcctagaaaaggattgatgcctactttctgatctcctttggatttggataaggttggtttaaaatttgagttcaaaagatttgaatttgaataagaacttagagtccaaaccttattggactctttccaaaattgccgacctctcttcccatgtgagaatcaatttttgtgagatgattttgcacaccaatttgatgtttctcacttctcttttgcaccctcttgagataggataggtttagttaagtttgaagtcaaatagatttgaatttaaactaaactacctattgtttatcctatcctatctcatttccacgacaaccttaaaacctctctatttatgtgcaacaaaaagagagtttttaccatggaaaatcatttctgagagagagggggcatcaaacagagagggggtgggtcattctgtgtgatagaaagagaaaaactgtttcctctttaggcatgagttctaaggtagggtcctagggtttcgactctagatttttgcgagagaaaaaatcaagaggatcttgttccataatttctacaccactatctcttcctattgttccatcctctaatctggaagagtccggataatctaaaaaaaaaagcacaaatcagtcattcagtacctttcgcacgagctagtacttctgacaaggatgatttgatcgaggcttctagcggatatcctgtaaaggtcagacatactgtgcggctcttcaacatcaggaaaaatctattatcatatctatcaacaacgatgatcatcgatccacattctggtaaagaatctaatctcagtggttaagatctaccattgattagtttgcttgtttcagatttgatctgcttacgtgattgacatgatcaatcatacttaaaattagatgttgcatttatttatgtcatatgatcctaattaggtagtttctaaatcagatttaggacatgcaaatagattaaattgtttaatctgtagtcttccactaaaaaaatttgaaaaatacatactttgaactatcgattttttcttcaaatggtattagagccatgcttcttagaacatgtatattatacatataatctgattttaattatttagattagatttgaataattaatcttaattctaagtagtgtagtagttgaattaggtagatcgccatagccgtctggtcataggagaaagtaggatttcatgactctgtcctcccattcgatgggattctcctatagtgtgtagggatactgtgcggttaattttcataaagatgaataatgaaagaagcttaaaaaattattttagatctaatatatcgtatgttagatttgaaattaattttcagttgattgtatgataatttataaaaatattttataaaatttaaaattatttttaaataccgaatcccaatctatatcagtccaaaacttaattaagaattaagtggtctagatttgagaatcaaagatctaagacctaattttcataaatcatggatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatgttagtaattgatcaaatctaattaatgattaattttgattgggttaattcttctcttgatcaatttttaatagttatagttggtcagagtccatgtctttaattagaccaagatggatttcgatcatagctttgtggtcaaacccaagtctataagttgatcgaattgaaactaattaatcagttggtgtctaaggtaagtatgacagtcttgatcggtggtcattaattggaagctactcgcatagattgagtctatggtgagttaatgacatatcccttccatcgatctcacttacctgaccaacatggtgaatcatgctttgatcagatcacttaatgattagggttgatccatgctagttagaaaatcagtatgactgatttagatatctccagtttgacttatctatagtcctctttatgacttggtgaagtcagtgagaggatttgtgactagtctactagaccaacttgtatctagtcttatttgatctgacttggtgaagtcagtgggaagattacgattagctggttagccttttctcttctctcaatacatctaactaaattctctaaaattttagatccttaaaaatgaaataattatgatgataactagatcatagcctcctattaagttggatgataatagatccaacagttgagatgatcattggaggtgccacatgcctgatgctcatctggctgtcagaattgttactcataatatgttgatttagatgtatctttctaacaatggttaggttggccaagctacactcaggcctgatcattcgattgttagatgcactgaattctgacatgttaatgattggacctaatcaagactttcagtggaggcaccacatgcttgctgaagaggtgcctggagcaaaattaactactaatagttgtttgatgaaataattgattaagaacctacccatagatgcacaaagattggtcgagccacactcaggctcatatgcaacctataaggattttaatacccaccaaaaaattagtataatttctcgaattggaggtagaggctatcaatttaaataaaataatgaaagaatctttaaactaaagttcatatctttaggcttaatcaattcatatactaattagattttgatttttttttataattatggccaccactttatcgctccgatcactattagatattgttaaattgatgggactcaattttgatagttggtatcgaaaattcaatatcgtcctgaaacatgaacggatcttgtacgtgatgacagatccgacatccgaggagccagtctcgaatgcttgtagtacgatccgagatacttatcaaaaatcactcaatgatcgaaccacggtgcgttgtataatgttgatggttatgaatgatgagttcaatcgtagatttgagaatgcttagccacaagacatgcttcaaatattgaacaagtcttttggcacatctaacgatgttgagaggcacaagaagttgtgctatttttaatgctcgaatgagagaaagagcatcagtcactgatcatgtattgtatatgatcgagttaattgagtgtttgagcaagctcgactttctcctacatgagtagctggaaaagaatacaattttgaactctccgtcaaaatcctacatctcatttcttacccattatagaatgacaaagcctacagtcgactatcataatttgctgaggttgctgtaaaattatgagaaggatcactagctctataaagagtcagtgaatatgatgggaggatcttcttctggacgtcgaccttttaagaaagagaagaagaacaagaataaaaggaagatgcaaagtgctgaggagtgccagcccaatcagataaaaaaattcaaatccaatcagagtcagtcggaatgcttctactgtaagaagcaggggcactagaagaggaactgtcctcagtacattacctctctggatccgaacaaatcgagaaagaaacaagctgttgctagataagataattatatgataataccttgtaatttttctatttatgatttcactatttgggtattagatattagaagttcttttgatatatgcaatttgttgcagggtctgcagattagtaggagatttgaagaaggcgaaaaatttcttaatattggagatgaaaaatctgtttcaattctagtattagggattgttaagtttatattcaaatctaatgtaattgtgcttagtgaatgtcacttttgtcctttatttttattgaatattatttttgtaggccttttggccatgaacagttatgagatttcaataattttttttaatatcattgtgaatggtgttaatatgatgaatggacaactgaataatagaatttatatattatcacaacttgttagtgtaatgcacacgatcgaaaaatatcctagaattgatgatgtctctaatatctacctttggcactgtaggttaagtcatgttaatcagaacagaataaatcgattgactcaagagaaaatcttcgaagtcaatgattgtgaatcacttccaatctgtaagtcctgttttcttgaaaaaatgatcaagtcatcttttattgaaaaagatgaacaagctagtgaagttttaggtttaacacatattgatatatgtagacccatgaacacgagtaccagagatggatatttttattttattatgtttacaaatgatttatcgaggtatgggcatattatttaatgacacataagtctgaatcatttgaaatattcaaacagtttcgtaatgagatagagaaataaattgagaagaatattaaaactcttcagtctgatcaaggaggagaatacctctctagtgatttttgatatatttagcagaaaatgagattctctcgtagtggacccctcttgaaataccacaacataatagagtatcgaaaaggaggaatcaaattctattagatatgattcgatctatgatggactttgcaagtatgtcgatctctttttggagatatacacttgagtcagcttgttatatgcttaataaagttcaaagcaagtccgtaagtaaaacaccatatgagatttggacagagcgtaatccagtactctctcatcttggggtttggggttatccgagttatgtcaaatgtttgaaaatagacaagctcagatttagatctgacaagtgtctatttatagggtactcaacataaactaaggggtattacttctaccttgctgatgaacaaaagatgttcgtcagtaataggacagtctttttgaaaaagaagtttcttgaggaagaaactaatacctctgaggttaaagttgataaagttcaaccgatagaagaaccggcataatatagtaaatctatagagtcggatttgattagatcaaatccaaaacctgttatagagacatctttaagaagatccgatagaataccgcatcagtcgaatagatactatggtttcttaatctaggacagtgatcctattgaactcgatgagaacaacaaggatccgatcacctacatggatgcaatgcagagatctgactccgataaatggctaaaagtcatgaagtctaaaataaaattcataaaggtcaacgatatatgaatattggttgatccacttgaaaagataaaatctatagggtgtaagtggatcttcaaaaagaagaggggcactgatgaaaaggtgaagatctataaagtccatctggttgtcaaagattatcgttggtattatgatattgactatgacgagatatttttttctgtggcaatgctcaaatctattcagattatgtttacaatagcagtacacctggactatgaaatttgataaatggatgtgaaaatgatcttcctaaatgaaaagctggaagaagaggtgtatatgatacaacctgaaggtttcatatctacaaataagtctaagatgtgcaagcttcaaagatctatttatggactaaaatagacatctcatagttgaaacatgtattttgataaagtgatcagaatgtatggcttcattaagaacagagaagaaccctacatatataagtggatccataattttgtggtcatattttttattttatatatgaatgatattcttttgatcgggaatgacatccctctattataaggaataaagatttgactgtcgtcacagttctctatgaagaatttagaagaagcatcctacatatttaggatgaagatctatagagatagatctaagaggttgcttgggttatcccagtccacgtatattgatgctgtgctgaagtggttcagtatgaagaatttcaagaaagactatctttcgataggtcatagaatttttttctcaaagcgagattatctgacaactcctcaagagagagagcgtatgaatagaattttcatatgcttcgatagtagaatccattatgtacgtcatgacatatacgagatctgatgtagcatactcactagaggtagtgagcagatatcagtccgattcagatgaaaatcactggaaggtcataaagatcatttttaagtatttaaaaaatactaaagaccagtggcttgttcatagagaatctgacttaaaatttatggagtttacagatttcaattttcagtcagatcataatgatagtaagagtatattgggatacatatatatcctgaataatgaaagtctgctgaaaatatttcaagcaccacaccatgaccgactctacttgcgaggtggaataaatcgcaatatctgatgctacgaagaaagctatgtagttgtaaaaatttatcgacgagctcggagtgacacctttcctcgatggccttgtcatgttatactgtgacagcacaagcgtcattgctcaagtgaaggaactgaagttacatcaacgtaccaagcacattctgtgctgctaccatctagtccgagagaacgtggatcgagatgatgtcgagcttcagaagatcgacggaaaggagaacccacccgatccatttactaaagtcctcgatgtcaaagagttcaaagactataaatcgaagataggtatataataatgtatcgattgactttagtccaagtaaaagttgttaaaaattatgtcccaaagtcaatcatcagtctgttgatggttgagctcattgttgtaattgtatatgaattattaaataataagtattatttaatttttttcatcactttgtacatcctctttgaactcttgtgttgtgatgatgtccttaggactatttgaatcgatatagaaagatatatcatttagttcttaaatttagttcacaaccaaataatatgctattattaggatgatagctatatcaagtgtaggtcattgtgcatcatagacgttggttgtcctcttaatcaaggagtgtaaagacactgacatgatatgcaaatgagatataggtgtatatcttactgaacgtgactaactgcagagtattttactatcaagagtagcttgtgaaggatatgggtataagtgtttcttcgatctgagatcatcatggtaacttacaagcaactcactgtactttggtatcgaactatctgaatttctaattcagtgatgaaaaatttttgagcacaatcaagaacttacgaaatcagtgtgtgagtcaagatggaattgacccctctaaataagtaatagttaatgcatcaatgtattttaattcagtaaaatcttgaccaggataacccatgtgatggatttaaaaagttgaaatataatgtagatggttttttttggattgatagtgaaatcttaggtcatcctgagcattcggatcaaaagaataaattatacggtaaccatatactaatgggcttttgaatattgtttagtaatctttcgatctatccgaatgttggataccattactagatggtcactttgattggtatagaaaaattatttttgcaccatcagcttaggttcgaacctatggggtcatactcaaaaaaaatttctgactgatcatgagactgatcatgattgagaattgttctaaagtataaccgtcaattcgattgacgattaaccttgcacaaaaattataataaattaatttactaatagttgatgaattattgaaggattgattagtgattagattgctaattaattcaatttgattgaacattgagatttgaatcaaatttaattgaattggattcaatttggtttgattcgattaagttataagatttaatcgctaaggatgtacgatttttgatttgatcgaaacttgaatttaattaatttttaatttgattagaatttatttgagataatttattacctaattagattaagttcaatgatctgaatggatttaacctaatttagttttgttgagaatctaattggataaaattcaaattcaaatagattggaaccaaagcccatgtgccaccttatatctatgcccttcttttcttcacacgagaaatatttctacatgaatatttctcacacccagaagaggattgacactcactttctgattccctttgaatttgaatgaggttggtttaaaatttgagttcaaaagatttgaatttgaatgagaacttagagtccaaatcttgttggactcttctcaaaattgccgatctctcttcccatgcgagaatcaatttttgcatgatgattttgcatgccaatctgatgtctctcacctctcttttgcacccccttgggtcaggataggattagttaagtttttaattcaaataggtttgaatttaaactaaactgtctattgtttatcctatcctatctcatctccatgccaaccttaaaacctctccatttttgtgcgacaaaaagagagtctttatcgtggaaaatcatttctgagagggaggggccgtgaaacagagagggggctagtcattctgtgcgacagaaagaggaaaactatttcttctttgggcgtgagttctaggatgaggttctaggattttggctctagatttttgtgagagaaaaattcaagagggtcttgttccatactttctacaccaccaccttctcctattattccatcttctgatcctgaagagtctaagtgatctaaaagaaagagcataaatcaaccatccagtgtctttcgtgcgagctagcactcccaggaagaacgatctgatcaagacttcgagtgaacatcctataaagatcggatatactgtgcagctcttcgacatcaaaaagaatctgttaccacatctatcagcaatggtgatcatcgacgcacgctctgataaaaaatctaatctcagtagataagatctaccgttgattagtttgcttgtttcagatttgatctgcttgcatgattgatatgatcaatcatacttaaaattagatattgtatttattcatgtcatataattttaattaggtagtttctagatcagatctcgggtatgcaaatagattaaattatttaatttgtagtctttcgctaaaaaattttgaaaatgcatgctttgaaccatcgatttttctttcaggtacaactacacttatctttacgaagagctgtgggaaggtcaagagtaggatctaagggaggaccttcagtttttggatctgatcgaggatattcaggatttggaggcaaaaaagagtcaactagtgtcaaagggccagggtctcaatcgacggcatagtcatttgcggatgagtgtagtggtgaggaagtggagcaatcataggtggatggagcctgataggtttggtacctataggagttaatgacaaagaaacagaagtgggagaggattgaatcttatacacaaaaaacttgtcatcggtaatagaagagatagatgaactagaagaaaaaggagtatatttaaagaaggtaacatctatggaaataagatatcgacccaaatcaggagaatcacaatgataccctttctgatgataaaaatatcccaaaaatatatacttgagtggtcgtggatctaacttggagaattgtgggcgaacatcctggataaaacaagcacaaccaaaaattttagaaggcaaagaaaataaagaataagaaaaataagacagaataagaaacttgaccagagagaatagaaaaaggcatctgattgattgaataacaggctgtgaaaatagcatcaatccaaaactatttagaaactttcatataaaatagaagtgctcaagccacttctaataagtgtctatctttcctttcagcaacctcattttattggagtgtaacaatacaagatgactgatatataataccatgttcgatcatatataaggtaaaagtatttgaaaaatattttttttgcattatcactatgtagagcacgcttcgtaacattgaattggattttgattttagcataaaagatatagaataaagaaaagaatttagatcgatttttcattaaataaagccaagtaactcttaaaaaatcatccacaaaagtaataaagcatctaaaatcagacttagactcgatggaacaagatccccagacattagaatgaataatttcaaaagggcatgcaacctgtttgactttagaaaaataaaagactatatgatgtttagcaaactaacaagactcacactcaaaagttgaaatagaacttaaactaggatataacttcttcagagcatccaagaaaagatgacccaaatgataatggatatcaaaaggagaaacaacacttgagtatgcaactgactatggcacaaaatcagacataatctcaagagtgtatagccttttggactcatgacctctaccaataatcctcttcatcccaagatcctaaaatagataatatttaggaaagaagtgaacattacagttgacagcatgagtaatcttactaacatatgataaattgaaagaaaattgagataagtacagaacagaacttaagaaaagagaaggcatggggcaagtagtaccactcccaataacaggagcagaagaaccattagcaagagtaatactaggcaaaatagaagaaagttgaaataaagagagaatacttgtgtttcctatcatataatctatagcacctgaatcaatgacccaattgcatgaggaagaggtgagacaagtaatagatttacctgaccgaataaagatagcagcagaagaggatctgaagccctgagaggcttagaattggatatattgggcaaactcattaactgtcatagttactaaccagcaaaaaatacctagataaacctccttctagcactagcgacatcttcctctaacaccaacagcacctgggctcaactctttcaatgtgattatataggctcaatcctgtcaccagctccagctctcttaggctgcgagcttcagaccaggtcataattcacctgggttgtgctgtcaagcatatgtgactcacttgatcgcataggatttcattatgcgtgatctttggtcatgcatcatagaaggagaaaagggtcatgcactacagaaggagaaaagagggatcttaaaagtcgatcagcagaggtagttttttttaaggattacttggaaatttttaaaaaaataatgagaattagggattgtaggttagttcagaaccctaggctctgataccatataaagaataatataaagagacaagagaaagaaatatatatataggctatataaaaaaataattgtgttattctttcatattataagaggctttatatatagagcaataaagatctaaatatagtaaactatctagatataataaaccatataatcaaagtttaaatataatgaaccatctagatacaatgatccatagaggtctagatataatgaaccgtctagatacaatgaaccattgatctcctaattgatatatttcttaaacagaaatatacaccataatgtataccataattgatctctaacatctatatttcagctcaagatcattacttgagattgatcttggatttttgatctcaaggatagatatctcatcagtgggttgtggggtgatttgagaagaaaagattatttaaaatcactgttatttaggatcatcatggtataaccaaatatgatgatctcatcatctccttccacattagccttaatcttgagtgaatcactccaaaccaaaaacccctataaataaaggtaacagaagactccaaagataagcaacttttttgcatgctctttttcatttattccagatttctaacttgagtattgggggatttctcatcgaaaccatctttgattagagatttattttacagatccgatctccagcaactccagtcaaagccagaaatctatcacaacatatatcattgatcataatcagagtactaaaattatctagaacagaaaatgatgagtgttgatagtttgtaacctatgcattatgttggcccaaaaataaggattaaaataatgtgagactattttcttaataatctaagttataaaatctattgaatatttttttttcgctaagacaaatctattgattttcaatctatatataatcatacatgtatagattatgattgattaggcagggagagatatgctgttgtatgctttgatgtacgaaggcttcgatacatcctcttaaaaatcaatgatgagctatccaaattcaagatccaaactatttggacaaactagattataaaaaagtcttaaaaatcaaaatccatatgctttaataatctctaacctaatcatcatgttagtatcaaaatgaacgataccaattatatcagtatggtaaaatatattatagggcacaaaaattcaaaatctacttcatgaatcataatctacatatcttgaaagatggatagatttaaattgacaaggttatgatgaataaacatggtaaaacataatgtcatggtatgacaatcattcctattgactcaaacttgatgttcaagtttgagatcaccacaatacaagaaattagtttacattcttactctgtggtctagatcatttccacatattccacaatttggattctgaaattggatggcatatcattatgtacatatacatactttcatatacatatatagatacacaaacatatatgtatgtatttatgcctgtactgtatatatgtgtgtgcatgggtcctgacatataactaaagaggttgggggtattatcgaccagagtttattttaataaataaaatcacttttttgatttagcacttgctatttgaggataagagaagtaccaacaaaagtggattatttttatcatgttaaataaaacttatgaaatttttctaatatgcatcctattagccacattgtacatgccaagagccagtgatatttagcaagattgattacttatgaaacaccaagctaagtccattgttcttgatgatcataacaatcggcttttaagaagagataattgaggtctttttttcatagaaaaagggggtgaaggggggcaaccagcgtagctatctcttttagacatgaccatgagggcccccaccatgctcgagaatgtttgatttggagactaggttagaatggagtccacctccctaccatatgggctgacccagggaccaatccaataggtgagtatgtgttggggatgtttggccaggacaccaccacagaatttttttgataacacacatcacagtcggaagaaaaaagaaataaaatagaaacacaaataaatacgtagatcacccaaaaggctcgcttctatggggcatgcaagcttcactatgaaaaaaaaattacaagaagagatcacaccttcaaccctcgtatacccaatctctttcttaacaagaatctcttcctcacaaaagctctctctaggagatctcctgaacccttaaaacgatcgctgtttacagcctaacagctcaccgaaagcacccctgtctttgcactctatcggctcctctcgatttgttactgctctggatcttcgatcgaacacaccacgccacttgttctgttctctattaccacagggctgtttaaagccctaaaacagagctaagatcgaaaacattgtccaccaagactcaattatcggatcaagccaaatcatcagatcaagcccagcatcccgcgtagccatcagagcgtgcaccacacctaaaaaaatgtgggaaaaccatcttcgatccacgatggaccatgagaaatcggaagaaaaacacccgacctatccatgcaacctcctgtgagcctgatccaccgtggaccgcgactcacagtgggcctaggcgcccacgcgttcgctaggccggccagtgcgcacacctgcactgggcccaccctcgtgctctagcatctacccggcctagctgtgccaccatcgatttctattggccctctgccgccccgtgggccatgctacctattttcgagcttctctcatgcatatttcttccgtctggactccatttggactgttcttggactcgttggactccgtttgtcattttgaacctcgctgtagactctttgtaagctgaatctcgaggtatcaaatttcaataatctgcacctcgacttgacattcggcctcctcctaactttgagagcttgggattttttcacctccatgccctggggcaatcacctattgatcaaggatggacaaatatgaaagtcaagtcaggccactcaatcccatctccatcgtataatgtactcctcttgatctgagatctactcgagatattctccaatggcaataggaatctcatcctgcgatatcgtctctcatcctcctaagtctcgcatcttatgtccgatccacctctatctagagctccacctcgttctgggctccttctggctcctaaagctccatctcacattgagctctctatcatatagtaatatcctctcgtcctctttttttttctctagaataactctatcaccatgcaataccttctggattcctccaccaactattattttgtagcttctcgaattcagtctgctcagtaagataagattttacctgaaatcggatatgtattggacctctcccaatctcctcactacaccatcatgtgtcctccagctgaccattccgatgtctctgatcgcacagctcgatctatctagtagataaatagtaccctcatggctcttcaaggagtcaaactgctcttttttataacatacatgctaggtgcatgcagaatctaaaattcactacaggaaagaagtagatacctcgtcagatatctccagaacatcatcctttgactcgctactagctgtcgctgtagtagccctcatccgatctctgagttgaggacaatctctggttagataccccaactcgtcatatcgataacatctggtcttgctcaagtccctcatccataatttggatcgtcctcatcgcgatctcctatcgctccatctgccacttcatgctccttcaaaaatcatcaaagttgagctacggccacctaagctcgaaatcggattcttccatctgagaatctcattctagagaatcactgtggtgatctcgtctatcttgatggtgttcttccccattagaagagtgatcaccaatgactcatacgaaagaaaaaatgatgctagcaagatcagcatcctgatcttctcatcaactttctcgccaacactaaggaggtcggtaagaatcttctgaaagtgtctgagatgctcctgcatgctctgttccttagtcatctgcagctcgtagaactacctttagtggaagaaagtattggagagaaactttgccatatatgattcttcgaatttcgaccatagtaccatcggagaagtctcgtcaagtacatgcatcatcatcttatccgttaggtacatgcagatggtactcaccacctgcatctggagccacctccaatcctgcacctccatgatagtcggcttctcctcacacaagagagcatcgatcaacccttgctggatgagcatatcattcactctcgcttaccacaaggaggaattactctttccatcaaacctgttgatcttcactttgattgagtctatcttctccatattcaatcttgataccacaagcacaacctgcatcctagtaccacctcgctctgatactacttgttggagatgtctggtcaggacaccaccaccactggatcttttcgatactacacgtcgcagcaagaagaaaaaaaataaaatagaaatacaatcaaatacgtggatcagtcaaaaagctcgcctctatggggcatgcaagcttcattataaaaaagaaaaaattacaagaggagatcacaccctcaactctcgtgcacccaatctctctcttaacaaactctccctcacaaaagttgtctctctaagagtccccctgaacccctgaagtgacagctgtctattgcctgacagtctgtctgaagcacctctgtctctactttctatcggcttctcttagtctactgttgctttaaatcctcggtcgaacacaccacgccacccgttttgttctctattatcatagggctgtttaaagccctaaaacagaggtcagatcagaaacataattccatcaggactcaatcagcacctcaaaggcccaccaaaccatcggatcaagcccgacatctcctatagccatcagatcgcacaccacacctcagaaaatgtgggaaaaccatcttcgatccatggtggactgcgagaaaccagacgagaaatacccgactgatctatgcgacctcctgtgagcctagtccatcgtggatcgtgactcacagcgggcctgggcactcgcacgttcgttgggctggcccatacgtgcccccacgtgcgctcgcattgggcccacccctgcactagactgcgctcttctgcgtgcactcgcgcgtttgtcgggcttggctgctccactgtcagtttctgtcgatccgccgtaggccttcaccaccccatggactgtgccacctattttcgagtttctctcatgcgtatctcctccgtttggactgttcttgggctcgttggactccatttgtcatcctaagtctattccaacaccaccaagggtcagaaaatcagatgcccctgtcggccttcaccgctccgtggggtatgccacctatttttgaatttttctcgtactctatttgtcatcctggacctattccacgccatctatttttgagtttctctcgtattccatttgtcatcctggacctattccactttgtgggctgtaaactcacgtactccatttgtcatcctggacctattccactctgtgggctgtgccatttattttcgagtttttctcatactccatttgttatcctggacctattccagcaccaccgagggccagaagatcatatgcccctgtcggccgtttttctcatactccatttatcatcctgggcctatttcagcaccactgagggtcagaagatcagatgcccctgtcggccttcaccgttctgtgggctgcgtatctccttcatcttccaacccccgtatcttgatatttaatccgtgctttcgtgattcaaacctgggttacttggatggaagaaaaggcccgttccattaaactaacaccacggtggcaggtaattgaggcctttgagtaagcactacggttattaaagtaagtctaagattctgaccagcctgcatcacctttttccatggatatgaatgatgtgaatcaccaaaagccaatttatattccacggtgatcggcaaaaggcatcagattccttggcgattatggtggaagatgattgttccgattgtagtgcattcctttccgtcctttcagctgccgacatcttatagacaatataaaaccaaaaaaaagaaaaaagccacttctttatggttatttaactgttggccgaacatgagcatgactattgaaagcttgctatctttctgagaatttgacgggaaactaacttactttttttttttttaatgctattctaaaatttttgtcaataaattgactcatgaactcgaagcaacaagttttaatatttaatttttgctccgaaaaaaaaaaggaattttatgcaatgagtcctaatatttcttagcatgccagtcttttcaaagaacaattttagttgctgcttaatggttctctttatgacagaattaatagagactgttctattttttccctgttcatagcccaaagctaatccttattatgattttgcttttgactgattgtactgggattcaattcattctttgacctctcctagaacggctccatagccaaaatattatatcctcaattatggttaatattagttcctagacatagattcctgtttctatggtttgagatttgtatattcttagccatgacatgtgcaatgctggtaatttcaaggtccatccatcatgctcagatgatcaacaagcaattctgatggctacgaatctcggaggtcgacctactcctccaacaaccacaatttgattgactcgactatgaaatctatatttgagatagcctatccatcaccgatgccgaaattattacacttacaccagggcctttttcttaatttggcttccacttttttattggcttggctctccatcctctctgctatagccttgtcttaaagatcctcatatccatctttctttatgtcaagttagtgtcggtatgcaataatgacaggattaatgtgacaaaacactggattagttaaatccccttggtccatctctgtccctgccatctttgacaatgtcttttcctttggattccacttctgaagatgcatcaactccattctaaggaagtttgttgtaatttcagaattccatccatcataactttaagcgcagtttgcgttcgcccgttgtttccacttgaaatatttcctcctccttatgatttgatgagaccacctttcctctcatatgataaccgattggcatgctccaatggatgttagacacatcgttgggtcgaggagaacatgaagaagtatggaatctgcaagcattattgtttaataggctcattagggcctaatctccttcccctccctcaaattcttgccaatgatgtaaggtgtgatgaaagatgagtatcattttccactaaacaaaagaagtgggcgataattgaaggttggggggagacatagcaacactttcactcagacaaagggtggggtagtaaatgtgttaacaaacgctttagaaccattgaaagttctgctggcttcttaaagtcaattgccatcatatttttgggcctccaccaacattattttcatggagaaaaagagaaatctctttttcttcattcttacttctcatgtgacattaacccattagactaactaattctcggaataacatctcgaaatgcttgagcgtgcaacatgcaatgataagtaggcagtgggagccccgtaagggagcttggtgttgcaagtcatggttctactgccactttatagaccgccgtcaaattatagaaagatgagaacgaattgcatacataattatcgcattttgttacacggtctatgaaagatttttcatcgcattcaacaaagagatcgatgcgtgctcagctttgtgtaagcatgatttatatctctgcttgcttaattatttcacatgagcccatgcaatatgccatgtgccaagtaattaaaatctcgaagaaatagttcttaagggaccatcactcacataaagtattggaccaagttctctcataatgtggagatcatgtgctgctgccattatccatttacgatcgaggaggctaccagcttggattaaggcttaggctggagtatcatcatcaagtgacggttgctctttcttgtcaattagctgtcttctttaaggctagtattattgtggagctcaagaaagttggttagggacaatgaactgaactagctagctagcactgcccattatagaatgcaccgttgcaaagctgctgctatttcttccctagcctcctcttcttttccttcaaagaatcaatttgattacaattttgtaatgctttgaaatcaagccaccaaatgcttatcacaaccatcagaaatacatgcatttgaaaagccccttgatttctttaccttccaaattttgaatttagctccttttattttggtgacaaaactaacttgctcggttgtgttgattattaatggacaagtgagctagtgactcaatccatttcgcatagtttccatgttaaacctcttgtccgagtgaccatggtgaacacctcataaagacagaaggacacatgaaaagtgcctttgtcgtgcggtctaaataagaaaaggttcgtatgaagatcaactctgaagttcaattataaatatcaacgtcctccttaggtttatcttctccaaactgccaaattaatcagaaaatcctccatgttataggctactcaagaccgatccaagatggccttaaatgattgaaataacctaagggactcagttctacatggtgtggaacacaataatatcgatcagcctttaagttttccatagattattttcagatttaggaatcactgggcatgattatctctatacgatgggtgcatgtatttttaccctctatttggtacagaggatggatcggaggaaggatggatgaggaattcatttgtttggtgaaatatgaaagaatgtatgaaaataattttctcttctatttaatataaaaaaataaaagaaaggacaaacaatatttgtatgacattcttaaagatccatcctttggtaaaacaatattgttcttatcaatttataatatttatttatactaaagaagtaagtaatgtataaacttataatattcataatttataattacacaaaaaaattataaaaatttaatttaatttaataaataatttaataaatttaataaattaatttatttatatatcaattatataaataaataaataatctataatttaatttaaatagtgaattaattttatacaactatttaattaaaaatagtaaatataaataaaaaatgaaagataattctaattatttaatcatagttatggaaatgatatacagaaattaaagataaataaaaaatataaataatatgaatgaaaaagtgaagaaatgttatagttttattaaaaaaattaatgaggataattttatcaatactcgtctcatatgctccatctatctttcttagattctctcaattttggaagatgtaaattgatggaccagaatggataggcaattcctcttttttcatccatcattcctaaatttttttgaactaaatagtaaatggagaccatccatctttacaatcccattcatcttccctcttataaccttaactagacatggatgcaccgatttgatttgtaaatcataggagcttctcgatcttctttttttagacccaattaaacttaatcatatgagatcaaacatctcaaagttaagtcacaagtttttttgtttgccaacttcctggtgtcacatgtttagaagtacactcctaagtctgctctcaattgagtaggcacagatatggaaagatagtgttaatgtggcttgaattttggatattttttatgggctcgaactatgacccgatccgaaaagcccgcgttgcgatctgaatgctattttttgggagatctgtgatggtagcggagggcatgggccgataggcccatgtccgaagcccaccactgacctcattgggggtgcggggggaacgccccccgcgatatggaccagtataaatattgtactttctgccaatctcggcagttttatgagagaggtttgaaaaatcaaattgcggctagggtttggagagttctgagtgattgtatctctcttttcatcatagtgaaatttttctctcgtgtcttgcctgtggacgtaggcttttcagtcgaaccacgtaaatcctgtgtttgttttttcttctcttctctatttttgtataattgtacgaatctgtatgtgccctatatttgtacttgctgtaacagatagaatacacaaattataaattatgtagaacaatagaatcattcagtattagatatcaaaagtattggttattttgaatattttggtgatccattttccaagcagtaattagctcagaatttttatgagaattaaaggtgaggcaaaaagtcatagaagccggttaaaagattagagaggtccttccttcccctccatgataaccaatatattcagttatacttgcaaaaatagctaaaagaaaagaaaagcaaaaaaaaaaaaagcacagcaaatatatccttcggaacatggtgtaaattattttagtatgaaaatatataacaataataaaatgaatatattagttcagctaagttaccatgggcatcatgatggaactaatctaccaaaagtgatcttttaaatcttcacgagttctcttatcaagaaatttacatttatgaatactcactctgttaccattaaggtggcatcccagtggaacgggtttttatttttaacgacgtgattcagattcgaatcacgacggatatcggactgtgattaaataccaagatgcgaatgactattgaatggagcatatcctgacggctcggacatggcgtctggaaacagcatctggtccattagctctcgatgaatcaaacattctttagtggaagttgggaccctataatcaccttcaggggaggtagatgcaccaggtcgccctcctccaactcccgtttcgaaaaaaaaaaggaacgctcactttattcaactttcaggaattttataataaaaaattttattttgttttctttcctttattttttaaaaagttagtttaaacacattatattccaacattatgacatgtgtaccaatgttgttttgcatgcatggactattatagcatgagatatatggagatgtttatttgggagttagcaaaaacagcaatgataatagtagtagtggctcatttttcttcaaaaaagtattaaaaatatttttttaaaaaatataaataaacaacaagatttgttaacttataccctaatccgtctttcaaagataggccttgcaaatcctgtggtccgttttttgtaaagagagcaaaaggcaaattctttgtgtaccgtaggtggtgtagaaaatccgacgtggagcgcatcgtcttatctgattgatctacgtaacaccgctttctaatacatatttaatacctgctgattgattttttcgtttaaaaattttgtattatgaaaatacttttattctttgataaaattatgatattccatatctatattatgacatcctgcattcagcaagtcataattttttatccataggatattataacatgcacagaatatcataatttttttaaaaataaaatatttttgttattcaaaaatttttaaacgaaaaaatcaatctgcagatattaaatgcgtattgaaaaatatttgaataaaaatactccttccatattatgatattttggaccatattatgacatattagattataatatgtcatagaatatcataattaaaaaaaataaaaaaaatttatataaatttttaaataaaaaaattaatataaaaatattaaatatatgttaaaaaataataacaacataaatcaatcgaagcccggattttatacactgccggcggtgcacggaatttctcgagagtaaaatgatcccggctaaacaaaatgcgttgccttcacggggcccaccgccctggcgctgacttcggtacccctcctcccgaccgtacgattcgctcctccaaagagatatcagatccgggacacgtatcacttaataagagagccaaactaaaggcaacagtgagagggacccgccgctgccagcgcaccactcgcaggcggccacctcgcgggggtgtcgcaatccggaagcggacgtactcggcgggacccaacccgctgatccagctgtctgataacgagtaggaccccccccaccccccagcgtccttcttgcagtcacacgtgttggtccggtgctgaggtcgctttcagaaaagagtagtaggggtatcccgcgggaaagccgagggggccgatccgtagagagccgtcggcatatgattgaaggccgttatgagtcctcttctctggggcccaccgtggtgggtcccacggcccacagtcaatttcctgggcccggagtggattcgcttttccacacgtgcctttctcacgcgtgcatctgctttttaagatttcctttctttgagtgtggctctatgtgtaccgtttgataaatacatacgtttcaaaaaagagggtttattacaccaataagcatagagggcttctaatcctacacccaattctagagagaagatatcctgtaccgcatatcacatgtaccatacatcatgtcaatcattttatcttgatcgtatgactgtatgcactcatcttgataattgatccacgtgaagaagatgaattctttagtatattgcatgattataatggtgcacgtggtataggatattattttgctctattctataccgttgatctattttttttttatgaaatcgaaaaaataattaaggtgaaaaaggagaagctgtgtttatagaaaattaaattgctaattacatcttcatcatgcttgcatggtgcaaatgaatggactcgatgtcaacgagaagagcgacgaaggttggattggtaggggagatgatgtataatataacatattgaattggctggaaaatgattggataaaagtgcatgcggcttggcaacatatttttatctttgtatttgtcttaaaggtcattttccctcatttctttttcggagagagcaccctcaagggacatggtgtgcatgatttgtcggcagattttagtgtggaaaaaaagggaggtagccattggagtagcctgatagagagcaggtagcatatcctgagatcacaagacaaggagtggtgtcacacatcagttgaaaagatgagaaccatcaaaagtagctttaggtcaaagcagtctcgttaattttgtccaaatgggatttgacaagattaggagagcccaaagtcttcatggggacgccggtgatagagagcgcaatgcaaaggaaaccagcttttgttacccaactttgtgaaatcctatgtgctgtatttttttcatcatcatgcctaataactgtcacggaaatgacacaaaagaaatgatgaggaggtgaaaatatatagtgattgattagccatgatctggtccttgaagcatttctctcttataatcaaaagctatttaatggcggccatgctcataaattctttaattacataatatcatttgcacacaatgcgagtagcaaatcccctacaaccaaagccatcggaatcttctgcaagatatcgacgcgggagtgcagcaatcgtgaagagcagaaagttgcaacttttttttacctcccagtaaacatgcattcatatacctgctaataaaaattaacagaccgatgatttatgcttaatatttgattgctgtttgatcgatgttttttttttttccttctaattaattttttggtcgtcgatgatcatctatccgggaaaaaaaaaggccttctagaaaattggtaattgatgaagttaaagataaccaaatacagaaaattttattaactaggtatatagaccataatagagtgtctaatcacaattagtgcggttaggaacagagccttaattttctgcagccaaatgctacacaccaaatgctacacaacaactaattttattaagaggatatcgttcaaaaaatgatgcttatcaaagattgattatgtggaaagcaacatgctataaccaataattgtgcacatcgccggcactgttaaatacgatcgagaccgggcgaggcaagatttcgagtcacgaccattggaggagccatggacgctggttttctgtggtaatggggaaggtctgaggtttttggaggggaagggtgagggacataataatggtccacctatggtaaatgggcaatggaccaagtgcgtatgtgtgtcctccgtaagccctacgccttgcaatttcatgaaattattgatgaccctttccaccttatcctcacgtattgttgtgagccttgtactttgatttgaagggacggggccacattctctctcgtggctattcccgcgggaccctcttgcgtcctgtgggagaaaggcccttcccctgcagcacgagagcattggctgtggccttcgtacgtatcatattgagggtgtattattgggttgacccaccgtactttaatgcacatgtacgtagttccaaccccattattttttttttaacatattcttggttgctcatgtagagtatagttttttcatacccacaatagacgatggggcattcacgagattccttttggcattattcacaaacgtgtggcaattcatgcacaagagtcctagccttgaaagagggagagggtccatttgtagggcagtgcaacgtaatggagtctggaggtcacaccttcccatccctatcttccgtttatatgatcctcaagcgataaggtctggggcacaccatgctcacaagttttaatggtgggtagaggactaattaactctctcatgcacgcagctccagcaatgacgcatgacacatagcagcagtgttatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatattacctgcgagtttggacaaatttaaacaggcagcgtggtaaatgcattatatatttatatatatggttgacctggaaacaagatcatgtgcttgcatatgataagggccaatgcatgatgatgattaattactttaattctttgaacactgggcggcatcatatgcttttgatcgattattgaaatctatctgtgaataataacatgctggcactagcctacatcgccatggccaagggaagccacataattaattcgcaaacaaggtgatcgatggagctaggtacatcaatgtcccaaggaaggaatataatacccttcatggagtttcgcaaaaagctatcgctgtggagtgtcatgtggaagatgcctctacgtgcctggttcgttgtcctggtctcatgcatatcttaattgcatggagaatctgcctttctgaatgacattttaattattctggtcatcctcctcctatgtgtacttacgtcctaaaagccatcgcatatatatatatatatatatatattccataattttttccttttctaaattttatcccagttttgggctctcgtaaagtctgcttgacttgattacagagcaccgagttaaaaataaataaataaactgtagttccacagcacatatatgatcattaatttcagagtattcataaagcaaaaatgatcaatctcatgctcgtccccccaccttcgaagatggattggatagtttctatagcagacctacaaaacacgcactcaaaaatgtatccaccatcccacttagggcaacttttggtaccacaccccctttagacaaagacacttggatggaaaatgacgttgttttcatagttttgagtggtctcttccgtcttttagcgtccgcagcaaattttgaaggaccttgcaacatatacatacgttgcatagttgtcatataataattcaggctaaacaatgatttctctgaattcagctcatgcaccataacatatgggatagaaacattaataaaaggtaaaaaggaatgatgctatatatatatatatatacataaaagggtgtgataccttttagctatcaagtgtgcaaaatgaatgtttattcagggagtgtattctccccccccccccaccttttctcaaataaaaaggaaaatgcatgcgctgagttggcattttatctgtaaagtgagcacatactattcaaaactctcatcaatagttttggaagctgctggtatcttcacaaataatggagtaagacgaagcagaagaaacatggaaatggaccttttggtcattgcaacgaatggtgggagacttttctctttgttctccgtcggtggggaagtgcgagaacaatattcccataagctcagagggtcccgcttttgtttggatgaagatacctttgtttttgtcttcgcgcgtttccactatgtatcaaagaaaggcccagcaatcctttaaaatccacaagttattgagccacacaaataattcatgacattgagaatgccaccaaaattgaagtcttggtggatactaaatgagaaaacaattcaacattaggctttcaagtcttgttaattaacaagaactgacacgtttcttgcccgggccttctctttctgacttgggatataactaattaataatttgatgaccgacaatggctatggtgcttattgatcttagcgtttagactatgatggcattaggctgaaataatactggggagcttactttttcacatcatctattaaaaaaaaggagagtgcacaatagattagcatgcaatttgtgaccccttgcgtgaccatgcatgattgtggcatgatcagttgatctttgtatatagattgaatgacaatacatgcatttcaaacactagctaggacggatgacagacactagactcaaaacactaggatgcttattttatttatttattttttgtacatcatcagctgaaaattttaaggatatattcacacctcggcatggcatgcatatgcatttgtgaccttcgacatgaccttgaatgtgaagccggccagttgatatttgggtacggattaagaagacaattcagttgaagcaccaatggtaacactagactaggatgccacattttctacatcatgaactggaaattcttaaggttttacacctcgtttggcaggcaattgtgaccccagacattgactttgatggtggcacctgttgatttgtgggtagatattaggaagatcgacgactcggttcaaacacaacaacgacgccagattgaaacactgggatgctacttttttatgtcattgactataaaatttaggactgcactccttatattggtatgcagttttcaatacttgtcccatgcaagatttgtcatgctaatctttaattcatccttaattaattaattgagattgcaattcagctcaaacaccaggatgacactcctgcaatttttttttttttcctataaattcttcagtgttaaaaataaatcgtatttaagttagaatatataaaattttcacatttataatttgagggttacacgtaatgacatgcagatgacaagcaaaatatttgtacccctttataccagctgcaaccagcgagttaactctttgtcctagttacctgaagtgtactaattttattaaagagacctagtatatataatatctagagatgtcggccaaatccctagaagaggctttgatataacatgattatagcctagaaaaggcaagaaggagatatgcaatatactattaactaattcttctcggtttcatgcacaccatagcttagtcacaaagctgatcaccaatatatgaatagcttctgtgtattgcatcttaaatttttcaacaaacatggactacttggcctagctggcacattggttcattaaactctttcaaaaatgtgatgatttggataaagttatggtgataaatatgtatcaacatggcgatcaacacatgtactgcgaattaggtctcagtaagcctacaacaaaactaccatgtggcataattatctaaaaaatgcatctgtcaatggggtaagaggagactggaatatcctcaataatcacaaatgcattaataagctatttcgagcacattgcgttagccaaaacatccgaacagagcttaggaaattgccctaattaatgttttcactgttgcttgtgccggtggatacaaggtcatatgtaacacgggttttataattatataagatcattgagacttaaaagacaatgtcaataagaatacgatgcgatcaacatcctgacgggcttgtgctgatatgggcaaaatacattcagcattgtcccttggagagattaaaccttcacaagtgacgtacgttggcaatcaggtcaattaccatgccagcagcatatattacgcttgaatcatgcaccaagcttctcaaatcacagtggcaagatgtgacacctaaactttcaagttcctcattgtgaaaccaggagatgatgaaatagtaacctaaaattcagcttccatagaggctatctgcagaaatcttgttgcaatattccccccccccaacccccagcttccctttcatatgaaagggactcatctatatatatacgaccacagaacgtcactaatttgtgaaactgttaagttgggcttcaattagctagtactgttgttgattgaagtcgaccatggcatgtttgcagtgtttctgggctcgtcggatgctatttcacatcatatatggggacgcaagactctgcgtgttgcttcatcagcagaacgattgctactagcaataaccgccagtaagttttaatttcttgagctcatagccaactagctccatccaggaactgtatcaattcagttggacaaagacctgacaatctctctctttcttcttctcaaagttgggtagtttgcactcaaccaagacaataaagtccacggcatcggtaccatgtacagcacctcagtctagagagaatggacccccagggtttactttatatgctgtctattttttccctatatatgcctatacagttagttcgttctataattcttttattgactgcagtagttctacgggggatgcataatacgtgcttaattaatttcagtctttgagaactgatacttgcatactgcaatccggccatgtttttgagaatgcatggtgatatataattgacttccaatccttaattgctcctttcagcttgaccatatatattactactttaggaattaaaattcaccccgaccttgctagacatcacacaggagctagctgtgacgagttatcttccacgagtactgcaaagtactactacttacgttccacaactgccgacttataactatttttccaatattcccctactacctgagtggttatgcttcacacttgctgctgctagtatctcgatctaccaagttctcagcaacaaaatgggtcactcttatatatattttattctttctcaccaccatcatgagaattttgtgcatttaaaagttgtcctcaccatccatcttcagggaatgggttccacacgacgctagccaatcagagccagctatccttaagcctgtcttaatggcccatgtggccacgtttatcgcccataattcaagtgagagattaattaacaagtatagggctagctagctagctagctagctctctctcgaaatttctgggggactacatatctgccaacgatttttacgaccaaagactagatattttcttccatatgattcccatttattttcttgatattatcccctgattcccaaatggccatataaataaataaataaatatttacaagttagttttcggcgaaattgttgggtggtaaagacggtgcggggacctttctgcatgaactcactgaccgacgtcacctcaccaacttcacgtcatggtcaaagtgccaaaagggcatttcagtaaaataccactcctcggttgggactctaccgtcattttatcgcccccaaaaaaaaaggcaagaagaaagtaataaaaaaaagtggactcgttgttggttggctgaggtcccatcgattccaacatttggaccacagccgggtgcacgatttgcgctgatctaattaccgtccgactcgaggaccgacgggtggatgttggatggtggggccacccattattgaatccaccaatcagaaccgtctgataggtggtcctcatccaactgggcccaggggaccacaaccaattggctcgctataatcatggatcaaccatgagcgccagatcacgatcgccgtttgtacgatacatccaccatgaggcccattgggtttgtacagatatgatcgatgtgacatggatggttacagtcactcgcaagtaaactgccaatagaacagcaccacatggtgcattcttggttttctgctcaaaacaataacattaatttttgtaaaattcttatgtaattcttggatgggatggaacacccacatcgtcgaaaagggagcgtatctactactttcaggcttgaaaaataaaaatcatatatcccaaccgaagatccatcgcattcatcatgatttaaaatatattgaaaatatgtattaatcaaaaatcatttgttttcaaggtatccaatatgtgcagcgagtgagcagacaagaaatagatgatttttactatattaatgcactaaaacataagataaaatatttaattttattaaaatatgcgtagattaaaaatcaacagatttcaatatttagatgataataaaatatattctcatacaatcttaaccgctcaattttctgtctacttaactaatatatgggttagaagctgccaaacaaatgattttaaatttttaaatatttttaatagtataaattatgatcagcgatgtgaatctttgatttagatgtctgattattaactttaaacccaagagaaacaaagttcacctcttgttatattatttgtatgcagactagagatattctatggctgatagctaatgttaaataacaatatcaaataaagtttatcataattttcacgtggcatgtatctgttctatattggttcatgggttgctcaaatctagtttttcttcttctttttttttcctaatttatactcatattctattttgaaattttttcatggttaacggtcggtcgaatgctgaagggcccatctcatttgctggaaacaggaaggatctgaggggtcctatatatgcaacagcaaccacagacagagaaaatggccagaatctattagtattatgatattcttatcattattaattcccatccttcttttaatcaagaattacgtaggatcacatgcactcaatcatgaaactgtactcttctaatcatttatgaggaaataaaattaaaacgccaacatactgtgtatatctctgactattttattctaatgtcctccacctcccatggacacttgatgatttggtatatactggtgctagaaaatttcttaatttcacttcaacttgtaccatatgatcagggctaggcaaacatcaagctgaatggcattagatagagagacacaacttggtctttttcttcagggcaaaaaaaaaaaaaaggccatatgcataaactatttccggcattttgagccatcccactcgtgcaaataaagcctaaaatagactttccattgcactgtattaagcttacggtccactgtattactgttgcatcacatatacaagaaatcattagaatttaagcagctatgcagaactgtataagcaccaattagcattttcggaagctacagaacaaaaatgtctcattcacgtttaatgtatggagtgatactacttgaagtttttcttatggaattgaaggtgttatagcaaaaaaaaaaaaaaggatttagtataagacgtataaaatttatattttgagattattcagtaacgattactgctggagtgatactacttgaagtttttcttatggaattgaaggtgttatagcaaaaaaacaaaacaaaaaaaaggatttagtacaagacgaataaaatttatattttgagattattcagtaacggttactgctgctagagcattcaatggctgtatcaaagatgtgaactagttccacgggtaagtttcaccgtcccgaacaaaaagcaagagaaggatcaaattctcccaaatggaagaatgccaaattctcagggaagttttcgagtttttcaacatgaagaatgatgcccatttgttctgtattaaagatatagtatgccgttctttccaaacaatgatgaaactttccgaagtgaccagagatttgggaatttacccaaaaagcaaaaaagggaccctgctcccactgacacagtatcatgtgggaattcggatgggtatcttattttctagctttcttaagcaacataaaagtatactactatattagcaaaactccctcaactaatcataggtatttcctgccacgacaaaactttccgacccaaatctgtggttgctcctgggacaagttcttggggataaagggtggctagaaaaggtaaggttggattgcttcgagtccaatacaaaagagagcaacgggagagatatagttcggagacaaagcctttcctgaaacgtgcgtttgttaccttgttacttttaccggctgggtcctcgaagctaattggagatgaaagccctggtagttatctcgattaggatatcggagcgagtgccccaccgtgggtgctccagagacattaattccgggaaggggatgagacatttgcagctcggatgaataaatctccccctttctccccaccttcaaaagaaggggaggaggaaaagagagcaaaaaagttgggaagaaaacctctcaactcgatcccacccactcgaccgtgacccctcccgctctcctttaagatcagcccctttcctcttagctccattccttctccactgctgcctggatcgatcaccatcccttaatttccttgacattctcctggggatcgacgatcgatcgagcaggagtgatacccaagcctccctccctccctcggaccgcatttctcgggctggaaaatggggaggcattcctgctgctacaagcagaagctgaggaaaggcttgtggtctcccgaggaggacgagaagctcctgaagcatataactaaatatggccatggatgttggagttcggtccctaaacaggcaggtaaagtggcaccacacttgccatactcccacataaagtagctgcaatgcatgtccgacgacatgaccaaaataactagacatgtatctctctctctctctcttgatttttctcacaaatccaacacaattcaggccttcagaggtgtgggaagagctgcagacttaggtggataaactacctgaggcctgatctcaagaggggcacattctcacaggaggaggaggacctcataattgagctccatgccgtcctaggaaacaggtacacaaccccagaatctctccctctctctctctctctctctctctgttcgtttggtctttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccagaatactctcctcctctctctctctctctctctctgtcttttgggcttttcatggtaccactactgactactgagttctgacatgtcgtgtttcccaacacattctttctgtttctcctcttttctttccgcattcggcaggtggtcgcaaattgcagcgcaattgccagggaggaccgacaacgagatcaagaacttctggaactcctgcattaagaagaagctgaggcagagaggcatcgaccccaccacccacaagccgctcgccgacacccaggcccgggacgacaaactccctcccaacggcggccagaatattaattctggagccgatgacctcagcggcctcccctcccctgctgctctcgatccttccatacccaagcccgctcgatctttgatgctcacggtggataagttcgccccagagagctcgaacccgaagaattcggcggtgggcgctcaggaattccttctggaccggttcgtcgccagccaggagagcacctcaagctgccacccatccaattcgctcggctttttccctcttccacagttgagttatgcctccgactgtggcggcaatcagacggcttcggtcgggctctccgtgacccccaatccacttctctggtttaatcagagcagccggctgttcgattcgagtcctgaattcagttgcagcaccatatccactctagtcccatctgcctccgcctcgactctctccacttggatgggcttgaagtctgtcatcggtctcccaccggataatcctccaccgagctgtgccggtctcaccggcatttccaactactgggaggctgctaattgtagcaacagcagtgggagcagtggggggaacaccagtagtggaatcgaactgcagagcaatagctcctacttcgaaagtggaatcttcccatggccggacctgacgccggataaagacgctccggtccagctccaaggggagcctgaggacctgaaatggtcggagtacctccatggcgccttcccggtttccgccgcaatccagaatcagagccaacctctatacggcgacatcaaaacagaaagccgagtcgcggtcgatggcttcggtacttgttacccgaatcggcaggcacagcagcaacagcaagcttcggacatgtacggcaaggatttccagagagtatctgtggcttttgaacagatttagattgcgcgaagattggtacagcggagaaagagagagagagaccgaaagccatcccatgaacagaattttcgacttcagaaggctcgagtaataaaaaagacttcttttaaatttttacaggtgtgtgcgccatagatttttgtcttgtaaataggtctgatgatacaaagaattcagcagctcttcagctttgaatatttgggcagactgagtgggactagctaggtgcagaataaagcttgtttcagtgtttttccttcttttcttttttttttcttttcttttctttctgtccctgttttcctttgcaaattcacaaatccaaattatctattgtaaacaatcaaaatctctactttttgtttgtccgggtcatcttccgctctcctttctttactgcagatatcatatcaaactaacacatcggaaggtaataccctcattttgtgcatgtcagcagttcttctctgagattgaaaatggtttcgacttttccagcagtcaacatgcacttccacgaaggctaccttatactgtatatgttcccaccaagactcgatgtataccgcaatcaacctctcgttcactcatttgatggctactccaataaattctttctacttcatggggaaggatttggaggcaagggactgagaagcttgttgattcttaccgtcagaaaaggcaagaccatcgccttccctccaatgggaaaagcaaaccatctattcaagagacggataaggatctatagagtctacccaatagcagaaagaaagtgaccctcgaacccatatcgatcgtaagccatgtgatccggtcacctttacctccaggcattattttaagcccactttaatctggaaagctagaagcttgcaaatcaagagaaattaagcacgacacccatgtctatgtttaaatcggaataagatggcatagattgcttctttattctggtagttgtcttccccgaactagtgtattgcttggctatgctattggagcagggggggtgttaccatccaccacttgagcttgtgagggaattgctgcgggcacatcaaattgtgcgtgtgggcgcacgcacatgtgcatgcgttcgtgtgtgtttgagccccttggatgggctcctcttgatgctgatacttttcagggcagggagtgggaagggtataaaagtttttctcttgatgtggatgtgttcgctagccacatgatcaagtgctgagaaaaagcataaagaagaaaagaatttaaaaggtggagagagtgggtctattccttcctaaaagcatccggctcctgtaggctcattccacattcccaatattcttgctctctctctctctctctccaacaacatgccatgccatcataagttagaacgaactgaacatggcagacctgataaggatgggccagcacgtatttaagaactttcttacgaatattgatcaaaatgaacaaagtgacatgagatgaaacaagggaccgaaaacattgacttaggatcatgagcagacagaaattaattcagctcaatgaaacaagtactggagatatgtaacgttttcacctcgatgaaatttcaccgactacatgatagcatctaaaatattcaacatcttgcgagcgttgagtccagcaggggatggcatgaggaacaagcatggcatgttctacagcatggacaaaccgatgtcccccattaatttattatggccctcatgtctgttagaaatgcatgtgagctgtatggtaagatgcttttgcttgagctggaggaaatcatcgcttaaagaaggggacggaaccctcgagaaacagaggctgaacaagaggattagacacaaaaatggtccataaaatttcatctttatgcgccaccatagcaattatggaggcctgtatgacggcctttccaagtagggaagctgaggaccccacagcattgacgttccacaacgtcagcaatttttgtcctgcaaatcgacatgatctcgagcagagcattttagcaaatcttattgaaatacatctatgatacgtgtgaggggagcataattgtttgccaagtgcctcattatccaatgtaccgcacactatatgtgattcagtttatgtgcatgtactgaaaatgtttataaaagaaattaaagtaccaaccaggcagaagtcggtcaagtggccatgtccaaacctatataacagatgaacgcaggcaaatccttctcctttgtagaaaactgcccatactgcaatgtatctatcttctccttttatctggacaggttctattttgtattaaaatcatcaatatggtctgtaatagaagcctacctggtgtattgaatcctctgtccttctctcttatttttgagagagacagagagagagatagggaagagagacccagcattataattatccaagtctaaatgctcgaggtatttgttttttgagggaataaatgctcgacgtatcgacctctttatattggcagctatacagcagctcccgggtgttttaacttctaagtttatcttctccttttgtagcaaactgccgagactgcaatttatgcatcttctccttttatccggacaggttctattctgtattaaaatcatcagtatggtctatgatagaagcctgcctggtgcatttaatcctccgtccttccctttgatttttgagagagagagagagagagagagagaggagggagggagggaggagagacccggcactataattatccaagtctaaatgctccaagtaccgatctctatgtatttacagccgatcgttcaatcaatctttgactctgactctacatcgatcttacgaatataatatttcgactaacaatcagttaatcaatcgacaatcgattattatcaaccaacaacggacaaccatgacgattcagttaatatccaactgaagatcatcgatatatcagagtcaccatccgatgctcattcggacctccacgactatcgatctactactattactgacatataatcgacttaactttccacgatcacataaaatcggaatatgcggaacctaaccattataaacggttatcgactatgtgtcacgatcattagtgggcataaacagcctatgaactccacgattatggtccgataatttagtacaataaaaaagtgagaccacgtactcgatggttacacctgaatcatctataaaggaaggtaattgaacagtattggtaaaacaattttgggtcgagactctgtcatttcaaaattctaatctgctgttcaccactcccaactgacttaagcatcgaaggatctccgtcggatacaatttcggtcagtgagaacttcttttgcaggtgtttttctctgacgatgggcgcaacaggagattgaccacaacagattggcgcgtcaggaagaaaaaaaggatataaacaaccatgtcaaaaatcaaaatccagcattcaacaggttcagcgaggtagtctttccatcggaaagatattcctcccccacttccagtggtagagtccagttctttgcatcctatggtcactacagatacgcaaattgctgcacttatgtagcaaatgaaagtattaatggaggcggtccaaagcctccagcagtagcaaactcagtagcagcagcaacagctaccggtggaggagctggtagctcagacagtgccatctaggcacaatcgccgtccaccatggtattcaccctcctcttcttcagagcggcgatcgtctcgacactctcactgagacgagtagccatgttctcgacactcccatcgtgccacccatcattcgtgacgttcttcctctccttctcatgcatatagtatcaggaagaggaaaagatcgtggacaccttctgcttctccatcttcaagctcttcaagaggttgacccctagagtttctcagcaacagcggcttgacgactatgaatgtaagttcaagaagattgaccaccgacttgcccgactttaggtggaaggttgaaaatcctccaacgactatgacttccacactatctagcctctctctcagcgcatcttagataaaccgattctgtctcgattcaagaagccacagatggagccatacgatggctccaccgacccgatcgatcatttgaagagctataaggctctcacgataatccaagaggcaaccgacgtcctcttatacattggctttccgataattattcagaagactgctcgagcctggtattctagacttcaaccagggagcattaactcctttgagcagctcgaataatctttcatgatccacttcagcaccagtcgaaagctgtcacagatatcagacagtcttttctctatcaagcaaggtgagacagagacgttgagggattttatggctcgatttaatacggccacacttgaggtgagagatctcaataaaatatggccatatcgaccatgaagaggggtctgaggggatcaagatttacctactctctagacatgactctccttcggatctatgatgaacttctagagcgtgcgtacaaataattcgcgcggatgaagctgcttctgaccgacgccagatagacgaaaaaggtcagaagaagaaatagaagaagagtgaaactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggaaatgcttacagaagcatgaggagaaagtaaccagagtgttcggtcaaatggccacgctcaaacctacataacagatgagcactggcaaattctcaccccatactcaatcgcctagactacaactgcttatcttaatcttcttcttgtgtctctatatactttatttcatattgtatcgtcagtttgtttctgcaacaaaagcctacctggtcccctgagaaatgcaactacatttcaggcaaaacggagtttttaacttcatctactttctagtttgtagggctgatatctctatattgagtgcctctgaatcacatctgagaagttctttgtttagatgtctgcatccttctctttgatcgctcgttagtaacatcaatgatgtataacttggaaaaagaaaaagcaagagaaaaaacttcagacgtaaattcagaccatagcccactcaggaggcttatcaattaggtgccactgttaaaggttttcataggaaggcaaaacagagaatcaattaccgttaatgcctccatgcatcataaactcggttaccaacccaacatgcattgttcaagcaataagggatatggcaaagactattgtcttatgcaagtacatatttgattaaaaaagttaaaataggacttggatattgggagagcaagaaaagagaacaaaccacagcaataatacaaggaataggccaagatcttatattccacgaaaaggaagacaaattctcatgaatgcaaaaggacaagaaaatgcaatgaaaacaagcaagcatcaaggaagcagaagccaatacaagaagcagaagccaaagtctcagtctgagaggagagggggggggggggggggggaatttactcaagcatcaaggatctttgtaatatatatgcgaggaaagtttccccaagcattaggccatctattttgggaaattccataggttgtgggcatcaatactgactcctctgctgacttcgcagatttgttcacattcctgccaaaattacttacaattttcatggaatgaaattccttgacatcataattaccagccaatctctcccagcttgcccaaacatggcatccacataaacataagcgcaacacagttgttgaaacctgcagttgactcaaattatgctccctttacccaaaaaaaagaagaagaagaagaagaaacgacttccacgaaatgaattttcattcaactcaacaatagtgaataccaaaacaaacggttctgatgaatttaaagaacacactgaaatggttgtcactgttcaaacatggtgggcagtcctgagagatcaaactcagcaataaataccacattcctgaaaatttggtccggtaaaccttgtaacaaatggattcatgcgaacccacagcaaagagaatattgcagcaagcagaagtgaccaaactatgacaactgttggcattcggtgctggcggacaaccaagcccttcaagaatgggtacaaatggatgatcaccaaggatgagaggaacagcttggcaaacagtaggccccaagacccatatccactattaatagcagaagagatcccagagaccatagcacataaattaatgagaattattgtcgttggggatatcaatagagaagtccatctgaaagtgcacagctccctgagatcattttcaacagatttttctgtcaacacagtcaaattagttttcttccccattaaaatcttcattggtccataaataattgcaaacaagtgtgaggaaagccctccaatcacccagagctgctggcttctccaccactcctgggtcccaacactgctccacctcatttcaagaaaaccagtggcaataattgagaagaagagaagtgtgagagagatgcttccaatatcaccaatctgcaattttgaagtataataataatcgttgtcacaggatttataacatgcgtgacattcaaaacaaacacttcccaaaatttcctttttgattttttcttggttcataaagaaaaattattgagcagttgaagcttttttttcctcgattcatgcaacatacctgtggaacaataaattttccggtgataaggcagacagctggtagagtgcagtatataacaagaggaatggatgtgatggggtaaatggtagcgttgatgtaagctattctttcaaataacctaagcttgccaccgtatgcataccataccgggcaatgccggcttagaaggatctcaactgagccaatggcccactgaagtaactgatttaaacggtcagagaggctgattggcatgattgccttaaaagcaggaaggaatggcatgcaatatattgacctccatcctcgggcatgcatcttaaggcccgttaggatatctgaagctaaagagccatacatccaaccaatctgagcacaacaaggataatttagcacagagaaaaattaactaatgcatattcaaacttcattctttaaagatcccttgcttcccatcggccactatctagccgaacatatgcattgataaataggtttttcttttttcttttttcttttttcttttcttcaaattatcagaaatttatagacatacagattcataacatacacccagaataacagaacatacaaaaggtaagaattcatagcagattatggggatcaattatggtacaacaagcaattacctctcttccccaagctgtattctcttcataatcacagcttattacatgaattgcttcttttaggagatcttcacgtgttgcagatgttgagaatctatcatccttgacaattatcgaagcaataagagttggtgactgaccaaaatacttcttcaagctcagcaaaggagaaggattttccatttcacgactgcttggttccatgttatatatacctaagtcgtttgattccagatgtatggtaggggcataaacacagccatcagcaaagtctttctttcctggtctaccccagctaaatctgcaacatttgggttctaaaggtgggtcataaccatacaaagctttcctgttaaagaaacatccagtgcccacataaaagggcccttgtattccatcaagaccctttaagtttatctgcaaaaaataacgaggactttcacaggttatgattacaaattacaaaacaattcatgaagaaacccatctatcaaattggtttattgaaaagaagttcatcaagttgttttttctctttctcaatagctagtgacacttaaacacaattttcgcaggcgagtgccagagaattgccacaaagtggcaatcatatattacatctataccagaattacctaaagcatttatttggttaccagaaatacctcatgtatgttaataaacagattgatgcatgccaggaggggagtattatctggaacagactgcattgcccagatttggaatttgcaagcaaatgttcttgacagcaaaatgacacactatagagtagatgcaactcaaagaatgttgtgcccagataataaaacttacagtagtaactatccacacgcgcatttacctatgaaaaccgttcttaattatatagatattttcatcttttctgacaaataaagaaaaactatatagatattgatcatgaaaaatcattgaatatgtgcaactaaatactgcccaaatttctcagttcccagtgcaggtctgcaaatgcaaaattttttaatcctctaagaagtcagttacctaaatgcatatggatcaattctctttatttagtcagttctggacaagtatattggaagaatgcctgctttgattcacatactaaatgcataaatgcatcatggatgaatataacagcatacaagctttcttaaatgcaccgaatttaggatgagcatcaaacaagcaagcatatacatccagatcaagaatcaaaacatcttcatacatctgcaaaacacattcaagttctaatggttggattggctatgttatcagggttactgacataataccgaatcttgatggccttttcaagatgatatataattgggattgcatttcttaagtttgttgtgggaggaacttaaatccggtagaaagcaactgttgtttatatggatctgttgactcacatcatagaagattgtattgtggctagcatactgatcgctagtatcaatgccatcaaatctttgtggaaactgaacatagcatgccttctttgcaatattgggatccatcataaagcacatggcttctaggaaagctttgctgttgttgacatagtgattgcagttaaggtttagaatatacatcccatttgtaagaatggcagaaactcgaacctgcaggttgatcaacgggttcctaagcttttcttgatgtcatacctacaaagttacaatacctcaattgatgaaacagcacaaataatttaccagagaattcaaagctcctgccatcctgttgtgatagtaacctggatgcttttcacgggaaacataaacaagctgtggaagttctttaccctcattgtcaagaggaccaccatggcctaacagtatctaaagcaagaaactcagtgcaaaacatctcaaaaattagtacgagcatgtaaacaatgagtatatgcagcctaacatatataagcacaaaagaaaaagagagaaaaacctgtatcattcctggatgattttgagtgttatttccaggccacggactaccgtctctcatgatccaaccatcacaagggacattttgaaacttggcaactaagaaattaatttcgattttgaattcctcatattgtctctgaatacataggaagtcagagcatatgtaagttaccgtgaccacacatggttaaacaacagacagaaccttttgaaaccaaatccaaccacaatactcattctttatggcttgtctagtttcttttgatcataaacaagattttattcaagtgaagaaaggtacaaaaagggatgactacaaacaaaccaaactgacaactcaaggacatcacataatcatgcaatcatcctatgaacatctctctctgtcacttctacatgactgctaccacattagcatgatagcatccctactactaacagcagataaaaagaatctatagaggcaaaggaacacctcctcaagattgagataactgaccttttatatacatccaccaaaatgcaaaaatcaaatcaacccataccacagacttcacaaattgcaatgaccaacaaaccttccagatttaaatgatgatcaaatttcaagtttaccagagaaagtaaagccagctagttctgatgcaacaatcaccaggaaaaagatattgtttacatgaaattgtaagatcttcaaataaataagcaatattctttaccaacctaatgaaattaaataatctaaatcactgtatggggttgtcttatttcaattttttcttttaaaattttgaaaagaaaaaaaattacttcaagaaattagtcttgtttacttcatgcaatataggctatgcagatgcactcccagtcccctaaccttttcaaaagccactaaacatgttattgttctccaaaaataccaattctacacgtgttcaaacactgaagaatcatgaagccttgtaaggttaatcattggaattgatcaacagacactttggaccacaattttaggctattttttaacatagtttatgtaccctggagcataaatgataacacctccagatattcataattttttttcagtagctcaatcgttagcaaaccatgatagaagccctgatcctagaagaacattaatttcaagttatgaaaatccttacatgtacttaaaaggaggataaaattgaaggcaaaagcggtcgcatgtaggaaaaataggcaatcagaactacaagggtcattatttaacagaatatatcttttccatcaagaattattttgcaggttatcgaacaaaaaaagggccctgtaggaaccaccaactatatcacacactgatcaattaaaaatggagcactccaaacttgttcttaacaaaagatcataaaaccctcaaaatgtcaatatgctttgccatttaatggcttgcagcaggaacaagattaagagacagaatcaatgattatcaagtcagctctaaatgttggatgaccacacacaaaattcaaaaaatatgatctcaataagtaagcttatgtaccggatgtggaaaaagcttaagtacccaatctggaaaaaaaaaaaaactcaagccggcaaatcaactcctagttggtgcaacaaacttatcaaatgcaacatcaagctcagcatactcagctccattaaatggtcaaacatgcctatatgcagccaaatatatgcatagaatctctaattccttatgaattccacagaaaaacatgctgctctttgaccttgagttgtctttcttcttctttcaacatcacccacaaaattcaaaaaatatgacctaaataagtaagcaaatgtacccaatctgaaaaaaacaaccaatcctcatgaattccacagaaaatcatgctgctctttgaccttgagttgtctttctgcttctgttccacatttcctaacagttcaactcatgaagaagatacttctcagatctgatagacctctaccatgagaaatcacttagatttacagcctaaaagctacagcagaactgctcaccgaatccaaaccttctatattggtttcttcattagtcaccaacttaacatttacagttatttcacatatctgtcgattgttgtcactcacaaaatctgagctgttaagctcaaaccttggattgatttttcaaaatatctagctctcccttaggaatatatcaatttgatttgctattgaagattttccataatgaatcatgaaagacaaaatcatgtaattctttatcaatataacaatcttgaaccaaatcttatgtaatgacccaagagctcatcttaaaagactagccataatgtactatttggatttcttgatcctatataaatacccaaaatcttctcagcacaaccaatgtaggactaaacatgcactcacataggtcctcacatattttccatgtttaagccctgacattctcgcaagataagggtccacatctagtcaaattccattgcaaacatcacgtttgggccatggccaacccaaaagagcccatgctatggtgtcccctagtcacacatggattatggctggatccatctgataccatttataacaacctagaacctcatccaaaaaggttagccaaagatattatttaagttccttgatcctatataaaaattcaagatctccctatcgcacaactgatgtgggactaagcacacgctcgtatgggtcctcacatcttatttcgccaaacatcctcagctcagttgaccagcatccttatccccttacgagatatctagggttttgaacgtcatggtggcatctgttggaaattctcataaagtgacttttattgattatagaccaatttcttattctgatttgttataaaaaatatgagcgaaattgtcgtctgaatgaatggttaaagagtccataattacctacatggtattccataccgatccgaaccggctgctacaatccgtaccgaaccgaaccggcaaggaactatttcgactagaagtaaggtaatccttcattctatcactaaatattttatttttcatctttttttagccaaaaaccactaagaagtagaaaaataaggaaaaatcatgtcaaaatttatgattttggtatgatttcagtatatgttgtagatcattagatgatctacacgataacattaaaatcattaatttttattaattatttttttaaatatatatatatttaataaaaaatatttaaaaaaattaaattcaaaaaaatataaaatcaaaatattatttaggatgatttgagctattttcagcataaattttatatttgattgtgtagattttgatgcatgatatgcatagtagcttaggcttaatttcgaaaaaaataaaaagataaatagcatctaatgcatgttaataggcttagaaaaatatatgtaacatccatgacatgtttctactcggatctaacctcaaataatttttttaaaatttttaaatttaaaaatgatttttattatttaaaatataaaaaaaaattagagcataaaaaatatgtaaaagtggtaatatattttagataattcagaagtattatttgaagcacataacatatttttctgaattgatgagatttaaaattattattaaaaatttaaaaatttatatataaataaaaattatgagaaattagaattgtgaaacgtattaatcagaagtattttatgaagtttaaaaaataatttttttataatgaataattataataaatttttataattattaaactgtcgtattttgttaaacttgcaaaaatgagtaagtagtcagagcatgacattggctgggagtatggtgagatactctcagttcagcatcattggagatgtaaatagtacagcacaaagttcaaaaaaggagggatgactaggttgaagatgcatttgactggtggttatcaggatgagaccatatgtcggaaatgcccacagaaagtttgacagcttatgaagaagcactttgctgattctaaagcagcgaaggagaggacaaagcaaaagaggacagagatggatcatcaagttggagagccaccttcctatcatttcagagagacaggcctctactctagatgataaagaggcatagattaaggctgccattcagacaagtctggatgatcagtacagactggaggagatggccaaatatagagagcgatttgaactttatactggtgtgatcagtacagattggaggtccaactctgcgaccaccgaggagagtctgagttcaggaggaccacctctatcaaggagccagtcagaagaggcagacatagtatttcatcgatgctgggggcttttgtcagtaggaaatccgacagaaatattccaacaagagccaccattcatgatttgaatccacatgctttttctagcaaggattcaaaacaacatagagttgatactatgctgaagaaggataagaaaaaggatatgtgacgagctattgaatcatagtttcattttaaccacattccagcaaatgcaatggacaaaacttactatcggtctgccatgtcgccatacaaactgccagccccaatgtagatctcccagcatccagggatatctatggtcaggttcttgacagtaataaagaagattcaaaaagatgaatttttttttataagaataaatggctcatatacagactgacggtgatgtgtgatcgttgaaccgatcctactaaatgaagtatcataaattttttgatatattgtgatgaaaaatattttttcacaaatcaattgatacttcagatagggtgcacgacgccacctacatctttggactgatgaaggagatgattgattcagttggagagcagaatatcgtgtaggtcatcacagataatggaccgcaatataaggccgtcaacgagttgctgatggagcggcgatcgcatatttattggacatcatgtgctgcacattgcattgacctcgtgttgatgaatattgagaagcttcgtaaagtgcaacagacagtggatacagcccagtctattactaaatttatctacaatcatatatgggtactatcattgatgcaaaaaaatattgagggagagatcttgagaccggatgtcacacggtttgctacaaactatatagcacttgataaccttctacagaagaaagcagccttgcatcagatgtttgtcagtgccgagtgagaagagagcagatatgcgagggccggtactgagggaagtcatgtgaagaacttggtgatcagtcagttattctagcaatgggctgataagatagtgaaggttatcaagccattatataaggtgcttcgcaccgcagacagcgagagatacccccagatggacttcttgtatcatatgatggagagaataaagaaacagattaataagataaagctcaaatatgtctaggaatacatcaacattattgagcactgctgggactatcagatggatagaaatttgcatctagccggtaaacatgaattcaagaatcatctgaaaatttttcttttcttgtattagtataagtttacttaatcatttgtaaaatttattttcagcttactatttgaatccgaagttccaatacagcatattcgggatagatatggataatgagcttctcactgctctccgtaatatgatatataaaatggtgtccgattctgaaattgcatatatgtgtctacaagaggtatgttaggtcaattaagatgcgagtatttaacttaataatatatttattaataaaataaatatatttttcacagacgaaacagtttagagagaggacagacagctttggagtctcattggctgtcgtaagcaaaaaaaagatgaatccaggtaaattatatatcaacagtgaagactttgttgacattacatgcctactaatatcataaaatctgatatataattttgtttaatattctggtagctaaatgatggattcattttggatagtccacacaaaatttgaaaagtatgaccatccgcattcttttccagacggtctcctctagtgggtgtgagcataattgattgactttcgtccttatccacagcaaacagagaaaccatctgacacagaagcacctcaacgatcttatttatgtacattataatttgagattgaggctaaaatgtatccagaatgaagtacagctgaagtatacggatccgacaatagataattacatcattgatgatgaggatctgatgattggatggcttgcaggcaagcagcaggagttggaacttgatgagccgggatctcctccatgaccagccagtgtggtagctagagagatcaggatggatccaggacagtgggcagatacaaatattccccataggattccagccgataagccacagtctgagggatcacaggagagccattcatcacgtgactccatgtccgagacatcctgctagatatttaagcaagaaatactgagacaaagtaggtcatctcaagcaggaagaagacatccatcctcccagatacagcaaagtcagtcacaaagggacaccaagggagctcgaaaagacaaaaagaaaagaaagccagttgcagcaccttcgagagtgcaggagtaagctgactcaaatttggagaccaacaacagtaagagtaatgatagcagtcatagatctgatgatcacagagagactggaggatacaagatcactattaatgagatgcagtcgtagaatggtatttgattcaccgatgagtcccaatttatacatgctacacaaaatagggatcacggtgcacgagctgatagaccgcatgaggagatgatttcatatagacgacggcctcccagagatcgtccaatacatgatacagctgcaaatgaccttgtacgtagagtaggatctatggatgtgtctggatcatcctcatattatgaatcctatcacccgcaggtagcctatgatccatatggatatagtgtatcctagactttgacttccagtggctactatcctatgcaatccggagcaccttatggatcgaattttgctactgatatatttggatggacccctctacagccataccatcatctcgataatatctctcagagtcagaatttgagcgagagatctgagatgtcttacaatctatagaggataccttatggaatgaatattcaggattatagtactacttgattaaagaaatggactgatgttcctctggagtatgcagatgatccagatatgtatgagtggcacaaacacttgacgagatattagatcagcaaagatcttaaggttagcatactattctttataatttgcactttagatatatttaatgcattattttagtcttttagacttcttttattttttttggatgatagaattgttatataacacaaataaatattaatttggatatgaagtaatctaaaaattaataaaaaaattttgaaatcaattcaactgaaaaaaatttatggcgtaccggttctgaaccgatatgccacaacgtaccaagcaagaactggtatgggcctcgatatcgattcttgaaaccttgattatctgcgatcatattatttggatcctattgtcttagtcatgtaatgtggcagatatcagtatagacctgactcaattaatgagctctatgatgggtggacccattagcattactaactagacaaggttcccactccattactatatatattcgcctatagagaaatcctagggcatcaagatctctacgttcttaggacggaactatcctattgaggagataggatttatgccgtcattgttgatttttcttccacaggatgttgatacagcgatcattaatggtcgcttaagaatttcaaggtacgattgattattattattattattattcttttgggatctattattgaataatttttgtgttctaattttctgcataagatccatgggaaaatattcttccataaattccctacaattggtatcggagcctcgattttgtagaggattagaatcaaaatcaatgattttataagggattagaatcaaaataaagaattaatttaattgaataaaaaaattaagaagaaaaaggatggatctctttgaggccgtcccctcttttcttcctcttcttgccagtatggaaggagtaccaatgcgtgattaagaccatccagcggtgaaaggccgacgatctcgtccggatcgtcggatccaatcaaacaaacaaacaaacaaaaaaggatacgggggccgacagctccatgtcgtgccctcttctttccacagccggccgtccagcacagcaccacctgcggtgactggcgctagttcctccccgctattccccttctatcaccaataaaaaaaaagaagagggccaatggttcccgccaccatgccctcctcctccctgccatcaccgtaggccgccatctggccgacaacaccatctgggcaggcaacggcgaccttaacaggccatggtgccgagcaccatccctcccctcccttctgtcatctttgaaagatcaaacaaaaaaaagaaaagggaatcatcagatcctagctttaccaacgatcgacggtggaggtggcaatggagagaggccaatgggaagagagccatcaaaccagtattaagcgaagaggggcgtcgattttggcccccttcttcaccgaccgatcaaatgagaaaacccactaacgggtttcagatttcaacccaaaatccgaatccaatttgctaattcaaagttataagatacattttgtattttggtccctgtagaatatcatatttgattttggtcctccaaaaattatattttagtccctgtaatgcaatttattatataaagatctctatattcctatttagtccccgataatatttatttctgataacagtcttaaaaaaattgacatttattccctaaaatgaaactttgttatacgttaaaatgttcctattacagttagtcctagttcttaagtttattgcataacattgatctaaatattatgatctctgcaatgcaatttaattacataaagagccttagcatgctattatgaatttagtactctcacatttggtttaaataatgatatattttttagttgatccctgatttagaggattgtagatttcaatagatggtgaccaccaaagtgacccattcactgagatttgcaagattcctctgttcagtatttaagaggattagacaagttatgtttcgattaatagcttgatattggtgtatcaagataaatgagtccattcatgagcatgattggttaatccatgatttagatagttgtaggttgcaatagatggtgaccaccgaagtggctcatttattaaaatttgcacagtttctctatttgatatttcatggaatcaaatatgttaatcttggattgattgcttactattggtgcattaagttggacaaatagatttatggatatggctggttgacccctaattgaagatttgtggatttcattagatagtgatcatcaaagtggcccattcactggtatttgcaagattcttctgtatgatattttaaaaggattgagaagcattgcaaaactattgcatacaatcatctccccaaagggagcttattatgtgttataattttgaagtgaaatattttatgactagtgattgtgcatagtctaggatagttatgggcactggatcgtgcctgacacggcccgaccctggcccaactggtcaggatccaaacaggcacggcctgtctggtaaagcacaacccgtttagcccgaaccctggcctggcacggccctagacccggggtttggcgggccgtgccaggcacagcacgtggcccgtcaagcctgtgggcctgataagtggcatgcgggcctgatgggcgattcttttttttctttttttctaaaaaagcaaccccaatgggccgtgcctggcacggctcgtttaagcccattacgggccgtgccagccacggcccgtttagtgcggttacaggccctaccaagcacggtccgtttaatgctgttacgggccagacacagcccgtaatggctaattcaattttttttttttgagttggataacggttagtttttatttttttagtcattttaacccccaacaatcataaaacggctaattttagagataatttgaaaaaataaaaatattaggatttctgtaaataccctcctcgtctattttcaccacaccaaatcaattctcctctccttctctactattactcttctagcaatatttagcaagtattcaatatttagcaattagcaagtgttcaagtgctacacaagaggaggattaatccacctattggagccttagaggtccttattgaggtcctgaggagcacaagaggaagccccaaatctccacctacctctattcaatttcttcatttggttaatttttattatttgtataactcatatttagatttagcatcttttgatggaggcattttgacattcctctgatttctaatggagaagaaactactgtttctgcttcctctgaaaccaatacccaaagtcaaagctcggtctcttcttcccgtaagaggattagtgctgtatgaaatgattttgaaagagttatggtagatgaagttttaaaagcaaaatataaaaaatatatcaaattatatagttgtactagtaatgaaaaaactagctatttaaaaagacatcaatagagccatataatgagtgatgctcgttttcaaagtacccttaatacataagagggtaatctcgtaggttattttgcatataatcaagaaaatcaaaagaaagtacggataaaatagatagttaagaatgaattatcttttagcttatataagtcttttaattttgaagagtatattcaattagccttacaatctacttacaaaagaaccagtaaatgtacatttagaagagtagctatgactaattttttagtaatgaaacaaaatttaattgaaactctctctgtcctaaattcaaaagtatcattaacttatgatatttggacagcatatgttgatagttattattttattactgctactgctcattatattgataatgattgactattaaataaacgtattcttgcttttcgtatttttgatttttcacattctagataataaatttctaatgctatttaccaaattgcatattcatatagtattaatgataaaattatgtctattacttttgacaatatatctaataataattctgctgttagattattgaaggactcattgtatcccattttaaatgaaaatttactgcatattagatgtgaatgccatattttaaatctctttgttcaatctgacatatggttcaagatgttattataaaaattagaaatgcagtttcttttattcatacttcaagagcaaaactttaaaaatttaagcaaatatgtatagattatggtagatgctttaaaaaatttaaatttgatgtagttactcattagaactcaatatataccatgataaattatgcatatccatataaaaaattattaagtgcatatattaatgatcgtggattaagttttacattgatcgaaaatgattggaacaaagataaaattttgaaaaaaaaatttattagtttttataataccactaatattctttctgatgtttattattcaacctcttattcatttttataacaagcatatcttattagccaaaaatttgtacaacatagatatgatgatgttttagagcttattatttataaaatggaatctaaatagaatgagtattgggataggatatgtcctatgcataacttagctactgtatttgatccacgtgttaaattaagtagtgtactaactttacttgatgtatattatgaaaacatgaattaagatcccaaacccactaaagctgaggtgaaccaacttctttatgatatttatgctttatatgatgaaaaagttagtgaatctagtgcttcttgttcacaaacctccacctcttcttctagtacttctagttcatcatctattttctcattcattgcagataggagacatacacatgcttcttcaagctcatctacatcttcatctttaaatagtgagcttaaattttatttacgaaatgatcttcaatctgcatacgatgaaaatcaaatagagtcttgatgtgttagcctaataaaaaaatattaaaaatcaatattctgtaatgtctgctattgcacgtgatatcttagttatgccgatgtccacagtagcatcgaaatctacttttagcgcagatcgacgtgttctcgatgaaaagagaagtaggatgatcgacgaaataattgaaatgctactttgcttcaaagattaattggatgccaaagtgagacttcaagataaaggtggacacgatacaacatccgatgacaatgacgacacaaacactgccgacgtatgacgatcagtaagattttcaattattagtttcttatatttgtaacattttagtttttatcttttaattattaaggtgagtcacctctattttttttctctcgctcattgtattctgaaggtcaagcctaatcttcctctctctcttgtaccattttgattattattaataaaccgatagggatccatgccaaatcccccatcattacaagatggttttttatttttacaaaaaaaatctaacatctatatttaattttgctccttaacccttttttaatttataaaaaaaattatattttttaaattcaaaaaaaaatgatcgggccagcacgcgggccatgccgggcctggactgtgccagcccaagcccttatgggccgtgccgggcttggaccgcaagccgcaaaccgtcaacccagcccagccccttttaataggttatgccaggcacaacccgttactgtagcagtgccaggcacggcccgatttgtgccaggccaggctgtgtattgggtggcccggcctgttgcccatgtctagtctagaaattcattctaccaaagtagatgaaccttcaaaagttgatgatactttgctaagttgattctactgaatgctggagagatatcttatgtggatcactttttttcaaaaaaaagtttgtggcattgcatcaagaactctcattaaaataatacttaaaaaaaaatttcaagtatatatgttacccatatttgtccattgattaactgcataaaagttgtttagcagttagcacatttgcattgaataacattacacattgaagtgaggtaccttatgtgggtcactttctttctctgaaatttatgacattgcaccaaggactctcattgaaataatgcttataaaattttttaagcacatatattgctcatatttgcctattgattaactacataaagattatttagcagttagcactctacattaagtaacattaatgctcctattaagactctgactggaataaactataaaatatggaaacgtaaatggagcaatcactatgtttgatgaaatttggatgttacattgaatgatgatcctccatcttacatcattagtgagagtactttagaatataaactgcctacgaaatatgatagaaggtgaatcattttagcctaagaatcatgaagaagtctatttttgataccattctagatgttaaacttaaaaatgatgactacaagtaattatttaacctcattagtaagaggtacatagagtctcataagacaaggactggatagctaatggataagttaatcaatatttaggtatgatggcatgatgctgttagggcttacattgtgaaactagagagtattgcacctaagtttaatagtttgagacccctatccctaatatttttcttgctcattaagctcttaactctctccttatgtaatttgatcagcttaaaatcatatacaaattgtattgttccttaaaagatagttggacaagggctaatattgagattaagaagcagcataggaagatggttgagatctgatcgtgatagtaaatttggccactaaacgggaccttttattaaatacttgtaagagtatgagatagttacttaatacaccattcttaaaactcctggacaaaatggtgtagctgaaaggcataattacacttataagaatatgattagaagcatgatgaatgggtgcaatttatcatgatatctctagagtgaggccttgaagaccactatcaatatattgagtagaattcttaataaggcagtttacaagattcttttgagttgtccgttagtaggaaatccaatactaatctttttcatgtttgggactatcctgtaaaggttaaaatgtataatctgacaatgaaagtttggactagaactaattgttgttatttaattgactatgcagataatactaaagtatatagattctactgtcctgacaagaggtataagaatagttgagtccaattatgccagatttctaaagtctaatataaatgattacagatactcttatactggagatatgacactaaagaaaaataagttattattcttattttagttgtccaaaaagatgtcatatttcatcctagaaggacagtgggagagcaacatcaaatatataaatcgattatagcaccttcataaccagttaatgaaataccagtaaagatatcattaaaaaaaaggaaaactcatcattcttaatgaccatttggtttatttagatgagaatgactatggcattgactatatggataattcagtctcttgtaaagattctttaaaagcaatcataacactgataacccgttttgacctacagcttcattagaaaaattttatataaatcaaccatgaggttttattgagagtgggaaaaaacatatggcatacagacctaaaaggtaaatctatggccttcagcagttatcgatgaaatgatatcttaagtttgatgacattaagcattctctgggatttgaagataataaggtggatatatatatattttatggtcaataggagtaaatttctcttctttgtcttattattaacattattttgttcgctattagtgattctattgtggcacgagatcaaattttgctatctaaggtctttgaaatgaaagatcttagagaaactttatttatactcagtattaagattcacatgaatagtctgtgatatattaggattgtctcaaagagctcacattgattgtttactgaatgaatttggtatgtctaattgcaaacctagagatgtacatgtggtcaagggagacaaattcagtagaaaccagtgtccttagaataatgtagaaaagaattcataagaaatgtgccctattcaactattgtgtgcagttttatatatacaaagatttgtgtcagatcagatatagcatatatgatgagtatactttacaattatataacaaattcgaacatgaagcatttggatcatagctaaaatgtcatgaggtatttataaaaaaccataacaaaatatatgtcaactcttttttttttttgaaagactgatcatcttaaggcaataagctatcgtgattttgaattttactgtttgcatggatgatatgaaatctgattttattatattttaatgatggcggaggagctatttcttaaaaaagttcaaaacactcttgtagtattttgtgctgtgctggcagagtttgtagtatgttagaagctgcaactcattctgtttggttgagggacttcatcctaggacttatcattattgatttaatctcgaaaccacttcagatttactatgattatggtgcagttatgttcttttcaaagaataataaaagttttcaacatctctatccatatagagataaaaatatttgacagtcagagattcgattaaaacggactcattgtaattgaatacatagagattgatgcaatgctaacaaacccattgaccaaaggacttaaattcactatatttattaaacatgtgaaaaacatagatctattggaaccttttgatatgtttggttagtgggatcattattttttgttgaacatcatatggatgtcataaagcttttgtttttttttcattattttcataatgaattattgcatttatatttatgcacatatggttgtttgtaaatgatgtttaaatgaaagccttaagcataaagatatcgcttaagcataaaggtgttgtttgaatagaagtcttaagcataaatgtgctgtttaagcatgaaaatattacttatgttataatgatatcgttgatatcatgattcgccttgagacataaacgactcgtcttgagcatatgatgaaattataacataagtttaaaattgttgtagcttttattggaaagcataaaagggtttcatttgaaatcgtaaagtggactgatgatgagctttgtatattttgatcacatggatataaagttcatactacatgcactacatcactagaatccatgtcgataagattactaacatttgtaaccacagaggggtctaatatcaataaatgatatgaagattgctgtgattcaatgttagtggttttaacggaccgaattttttgactaaagatgttattcattcaagatatttgcatatgtggccacatgaggtgcgcttagcctagaagtcattttcaaactatatatataataaatgtattttcttgaataataaaaaaagatcttaatcaatgttgtccaaggggagaatgttgaaaattctcataaaatggactttcattaattatagactaatttcttattctgatttgttataaaaaatacggactaagttgccatctaaatgaatggttaaggagcccataattatctatgatcatattatttgaattttattgtcttagtcatatgatatggcaaatatcggtataggcctgactcggttaataggctctatgatggatgaatccattagcattactaactgagctaggcaagatttcctataccagtaccagtgccggaccggtacagtatgatatcggtaccgtaccgtaccgacacacggtatgcatcagtgtaccggttcggtaccggtactcaggcttttttttgttttcatttttttttgtggatgttgaagttaataattgataaatacaacctcaaaatggcattaaattgcatattattgacatattttggttcaattttgagttagatagcggtacaaagactcttgatccaaaatttcaaacatatatttatttacattatatttctactatgtcatcttaaaactaaagaaaaatatataaaatatggcattaaaatgtatctaaatatttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagatttttggtatgatttcctcatattttcattttacctcattcttatcctatttctaacaacaaaaataaaaaaataaaatatttactaataaaataacagattatcttatctccagccaaagatcagcttctcctcgaaccactcctccaatttcacaaaattttgcccctttttttctaatttttttgaaggtctcaacgaaaccgttgagaccttcgtagcccacgggtgttctctgagaaatctcagagaacactcttcggtgtgggtgctaattaaagcaccaggcccaccccccctcccggccccccacgtgaaaaggcccactcccccctcccctccccacattttgaagtggggctgtcggtatggtttggttcaggccgaaccagcatcgaaccgaaccataccgcccgattccggacggtatgggcccaaaccatgccgaaccgggcggttcggtgcggttcggggtcgtttttcggaaaaaaggcccgaaccggaccggtaaggcatcggtccggcttggtacgcaccgtaccaggcggtttggcccggtacggcgaacgctggggctaggtacccactccactcctatataaattcgtctgtagagaaatcctagtatattaagatctctacgttcttagggcagaactatcccattgaggagacaggatctatgccgtcgttattgattttttcctccatagaatgttgatacgacgatcgttaatggccgcttagggatttcaaggtatgattgattattattatcttctttttttgggatgtattgttaaataatttttgtattctaattttctatatgagagtcatgggaaaatattcttcaatacaatccccacatcttagttcgccaaacatcctaagctcagttgactagcatccctatcctcttacgagatatctagggttttgaacatcatggtggcatctacaccgtattttttgaaatgaaaaagcatcacaccttagctcttttgtaaccacgcctcaacaaatgtaatttagtaaatcatgtgatataccttgatatgagcaatatgaagtagaggttgaccatcattgaaatgtgacatccaagtgcgaccgaaattgaagggtaaggtacaatacacacagacatgttgatcataggtactcctttggttctttaatcatctattaagacagaagtaaatgaattttgttcgttccatggataaagaaaaatattatgacttacacaattaatgtacaatttggaagtcatgcatgtatgcagcatgaacaaatacaagtatctatagttctgcattaaatatatgtggtcattaacaattatgatttgtccaatagaattatggagattaattgtgatttcacatgcaaacaaatgtatattttttccagcaggctataggctattaccataaaggtagttcagatataatgattagtaaataaacaaatataaaatcaaaaagtacagccatgaagacttagtaccttcattgtccttctttccttagcaaatgttggacatatgttgtactttagataatccaccttctgtgagaaataaaattcaggagcccttggttcaatattgaattttttacagaatggcacccatttcctagcaaactgacaggttagtgttagggcttcaaaagtcaacagtgaggccccatcatcagagacataacacgtaacactctcggctggataatccacagccaggattgagagcacagtgtttgaagtgacaaggggtggttctttcagtggatccacagtagtaacaaacacatcaatgcaggcaagctgacatggttttcctggttggttatatctgaaaagaagacgattctgcaccttatacacatagttggacagataacttagagacttaaaatagacatccagaaatacatatgcatgtacgcacgcgcgcgcgcacacacacagagagatttacctcaaacataagcgttctggatatgttatccttgtaataggttgccatttggggagctgattcaaaatccaagataaagcaaaccaggattcacaaataattgaggttaaccaaagtccatatgcattatggactggattaacaaggcgataccggaagaagaatgctaatgctacaatctgaaagatcataacaaccctatatggattaatctttgaggaggggatggacacctttctagaaagtggctgacgaagttcctcatccctggaagcagggaagaaaataacttaaaacaatatgcaggaaaaaaaatgtacaaaccattaatgaaacagtaaaaaagtaagcacttttgaatcactttataaactacctaaagagaaaaactctattaacaattcagaaagtccttcaatgtcattccatcctctgagagtatagcattgagacaatgaaaacaaatgcttcacaatatcttatatgaaaacaaagtttcaaaatatcttatatgatcaattttatctgatgcaccatcggcatttccattcttaaccggacacttgtttcatatgacttcatttgttgaaatagacttcaagactcatgttcatagggccctgcaacatttcagaaacgaatcaacatgccttgttccaaaatcgtacataacatggggatggcagtagttattttcttatgacaagtttgtagagataaggattacaagtacccacacttgtcagcactccatcatccagtcataatttagtgtttgcaataaatctaaaaactaattcaaagccaaaaaattgggcaaattgctaaagaaagtgagggataatgaaaactataatgattggatgaaaactataatgattggatctaaaaacaaacaataaaaacatgtcagttaatgcatcgacttatacaagaattataagttcaacattgaatgtttagatattcactgtatttggtgaatcattggtgcataaacacatatttggatttatacataaaatcaaggagaaatatttgacaaaagattacactaatttcagaatcatgctatagattatagaagcatgagttggaagcatcatgcatgtcattagcaattttttttttttggggggggggggggggtcattatgagacattttttctcaacatcaattgccagaatttgttaattgtcctcgtcatatattatcatgtatgaactattatcactcatttctttacttttttaaccctttagtcctttgaggataaataagggcctcttatccaccaatatacaagcaaggcaactattcatgaaaatggattacaaacagattaataaaatttttactcgtacatagaattttttttctaagaaacaaccccatttcaaaatgaattaatcattgatctagtcataatgcttaaacttattaaaataagcagaactcttatagtcacaaagaactgaaaagacaggcaaaaattgttaccaacttggacacaacattcattcgcgattacttaaaaaaaaaaatcttacgaaaaagaaattgaggagacagcaatcaaaaatatattccatattaaattttactataacttctaccaagttattgagcattgtatagcttattgtaatagtgagagttccattactttactcatataaccatgagttagacaaagtttccatggtaaatcaagaatcatcaactcagatatgaaaagtatgatacgttaaaaacttcatacctttctaactgatccctttccacttccaaaagaggactagaatcatttactttaagcaatgtctcatgccctctagttgtgcatgacatcgtctgctgagaaagcttccactgctgaagcctttccctccagaaagcagtattaaagctcattaggactgattcccgtggatattctttctcgatagctggaaatgaaacaaaggaagcacaatcatgaaacttcaaagagcagaaaggttgaaaatgaagatgtaaaggtgcatgcacaattccctgcaatttgaaggagatgaaagttttaaaactcaaaaaaatgcctaacaaagtaaatacctgaatagaatggtacaggagaaggaaggaaataatctattctcccaccccgaatgtcaaaagatggatatgagaatgtacacctctttatgaaatgagagggtagcccagtatatgcctgtcaccagcaaaaacactgcttacagactgtgatgagtccaagataatgattataatggataactattcaaatgatggaaagcaaatgcagaaagagaaaggtgaatataaatactaacctttagacccttccagataattctccttggaggaaaatctaatggaacaattgtcttgtttggatagtgtgaggcgtcattttcttgttcccatctataatttgcagcagtgtataaatctttactggatgcagggctttccaagttgcttgagtccacaatatgtttcgaattgtgttcccagctatcagcagtgcattgtagttcatcacttactattgcaggaaactctgtcccaccaatagagctcttccactttgttagattcagatttgaattatctgttaatcaaagtattggaaacatatgaatttatgaatttatgctccttatggctgaaaaagcatcagtatgtcaagctaaccggtgtgcctcttgtaggtattgctgcatttaggacatgattgattccccactttccacataaattcatagcaggtcctgcacactggatatccacactcgttgcaagcaagaggtggcctcccatcttgatgagaccctagccaacttcgacaaacttcacagaattgatcatgtattttctttctgatctggaaaaatatagcgatatactaaggccttggactaatttaccgtcaaaggggcttgactgataaagcaggaagtgctggaaagtttgtagccaattcaagtttataacagagtcatgataatgctaaagattagtaaaaataaaaaattatgtttatatgacatattgcatacataaaagatcaaatggtacatttagtactaatttgacagtacagcaaattgtttagattaagatcaagctttcagttttcatccaggattggaatcttatccagtaaactttaagaagaaacaaagtacttgataattggagaaatatcatgaaaacaattataagaattaaagtgctagtacaatattgcaccacccaaatgtattcaaagtaatggggcactttgtgctgaaagaagggaaaaaaaacaatgaacgaataagaaaaacaaatgagccactgtagtaaattatagaccagatgagagacagaaaagctctgaaaaccatctcagcttattacagtgttatcttcttgcttgcacaactgatggtagactgaaggataaataaaggtaaattggtggacatgacaagtgtaaagaccacttgcttgcaatttgttgatgacacgttagtattttgtgaggctagtgaaggttatatttatcttgcagtgttttgagctgatgattaaattaatatacatgggaaatgagagccgagttggaagttaaattgatggacatcttgaaatgtaagctagacaagtttcctgtcacccatctgagttggccattaacaacctgagggacttggaaaaactgactggttacctctagtagataaagttgaaagaaggtagcccattttaaaaggcaagttactttcagccgtggagggggaagataggcattagttgcctctgtcttagcagctatgccattgtattacttttccttttcctcagttcctagatgggtctaatgaagaatcgatagaataagaagacatttcttacagagacagagaggtgaataggggctattacttagcgagctggaagcatttgcaaagataaaaaccaaggaggactagcaatacaaagtctgcataactaattctttcttgtgaggtaaatgatgggggaaactgctttcaaatggcaaagatatatggaatccatgatccttaattcctatgacagaagggcaggattaaagagggatcctgttcatcctggacagatgcagctttttggagaggggtgcttaaaagtaaagacagtttcagctgtgttacatcctatattttgggaaatgggaggtcaacttgttttttgtttaaaagagatgcatcgaggagtagtactgatataaatgtttcctaaccttttcagtatggcagttgaccctaaagccttgtggcaactcaagttaagaaagagacgggaacattctcttgggcattatctgtcgagagaagtgttaccgaagactatgctcagaaatttgccagtccactttagataattagatacagatttctactttacccccacagcagatgaacaaagtcagatggagatggaattggaattgttgaggcttcttctctgtaaattgaaaggatgaaaacatgtatggaaggttccagctcctgggaaggtaaaatcttaacattgcaagccatcaaaagaaaagagctaagtgctggtaatcttgctaagagaattagctccattctccttcatgtttcctatgcaatgatgctacagatattgaatttcatatgtcttgtagacataaaacgacaagaagaatttggaagagttgtacggaaaagttacaatttaaaggttggcctgggtctctacttctacttgcaacatgttggttatggcaatctagtggaccatacagaaggagaggaataagaggattttcagttttccacagatagatccagaaaagatgaagaacttatgcaagaaattaccaaacaccggaaagaatggctgcatctacctcttcgaagcatgaaaaatctttgaatcatgttaagaatctttacttttcttcatgttgttttctaaatgttttctacttcatttcattatttcatgaaatgcactgatggatactccccgcctttgtatcaaagagaaaagatattccattccaaaaagctgatgaaacattaaggagacttaattatgaccaagaagtcaacactcaacaatgtaggtcagggtttcaaatatcagtactaggcttcatcttggtatgctcctgagaaggtatggtattgggataggatggtatggttgggatggcctgaaatagtcaaaaaataacataaaataaaataaaaaaaagaaatataaatatatatatatatatatatatatatatatatctaggttagtcccaaccatcccactgcagggatgcacctcagatgattgggacaggtcggaacatccaaattcaaaagagaatcagtgttccacacctgtctcaatcctgtttcctgtcagaatggtaccatggatactgtcgcttttcaataggacctaatttcttgatacctgtacgagttagagtgaatttgggacttccaaggatcagagccaagttaataagggcaagatacttgataggaagagctccaggtttgtagtcaagggcagaagcaagctaggtttatagtcaagggcagaagcaagcttgctctatctggatgctgcaaatatatacaaaagaacacaagcagtttacaacaagtccctgaaagttttgaagacaaggtggaaaaatttagctgccatgatctggtccaaaactggagatggttgtacttcatgaaattaataaattcaagcatgacctccataaggctagatggcagacaattttgcatatcaaattacaacctgtgaagtttgagattgtcaaatgaactcagaacctaatgccaatcatttgacttggtacaacatacacagccaaggttcctgtaggcaagaggagtctgaagaccaaaaccaaaagaccagttggcaggaaatatattttaatagctatttatttcaagctaatgcaacaagggagaactttaggcataaatggagtctacatgacaaagaaaagtgttcagattaagtctcagtttgcctttttggctcgtaagttatgctttggagatgaaaggcgtttcttttataagatttttgttcctttctatttctcctagagtctttccaagtctaaattaacctaacgtgattgctcctttgttctacaagaataagaacagttaatacaacagctctccttgcatgccaacaaatggacaggtttcttgccaagcccctctcgtgtatagttgccttagctaggaatttgacttccaatgcataaagggatatgaattgagagccaaatgtaaaatattctctaacttttgtctatctagtactttcatacatgtaagtatgcttgtcttcacgtagtaagttttcaagtacttctgccagtcttgcagattacatttagcttatatcaaatgagaaaaaccttacaaagtgtagtagtacatgcacattccagtctacgtttagactacattaatgatcctgccagattatctttgtaatttaccatgtgtagggcttcataccacatttcattccaccaatcatgtagtccagcataaaattctatgaactggccgagtttcctactgatcagttatgcttgcgtgaactgatgtgtttggacaagccacttagacaacagaacgccaagaacttttcaagatttagtggagacaaaagaaaaagggaaagaaaagaaaagattccacctttcatccctcaatcggaacaaagtcttgcagagccacagaaaaagcgaatctttcccaacaatagggaaatccaatcacggtaaaagttaaaggaggctaaatgcagcatgttaccataaaccccattgcctcaaaggacaacgctgtaagagatgattcaaggtaaacaaggtcgatacgttctctcaccggtttctccatcagacggaggtagccttcgctagactatagtctgtgtcctcttcttcgtttcccccgttcccttggagatggcctcgagaaggtagcaaggaggacggcgtggagggtgggggtgctggcagaagaatggaaagaggaatgggaagagaaacaagacccggtcctggggacaggaatgcggagctccatggggtttgggaaggggggagtggcgagcgctcgcgagagagagagagagagagagagagagagagagagagaatagagcgagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaaatcatgaatgatttgatccgagaaagatcatggccactttgatccgagaaagatcatgaatatttcgatccgagaaagatcacagaaatcgatccgaataaaagatcgtcgcatgatcctggtagtccaaagtcaaagccaaaaagaaaaggatttaagatgatgtgataatagaagaaaatagaaagataagatatgaaacaatcattgaataaaattatttcacttattaatatattataatgtatctcttttgataaaacagataatctataaatatttgcagtattctggacagtgaacatcgatttttatgtgttattgcttatctttattttcatattatattattatattcatgtgatatgagaattcttactgggctgtaaagctcacaccccttcatctttcttttcttctcagagttacaggatacttatgattggctgtggcctggatttacgggtgagcagaagaataaataagagtgttatagtatctgatcagagaattgaagaaatttaaattgtaattacgcaagattttatgaattattgttgaaataaattattatggttgataaggttgtaatgatttaatttggccttgcatattctttagggcttgctctaaggagtgtgcggccatcatatatccgatccggatgttgggttcgaggcatgacagaaaaaatattatattttaaaataaaaattaaaaaaaataagagtgctccaccctctccgagacccaaaaccccagtcctgaatgctccattctctctcaaaattttagccgctccaccctagtgtccaatgctcttgctgcctatgcaccacccctcctctccactctcaagctatatagcccccctctaggaggacattggccaaacacctaattatttcttaagcatcggatttactactcaagcactgaattattgtcgctatagggaccaaattccatgagaattccctctagggtggatctatcaaatcttatgactcaatactattattcaaaaaaattgatagtgtttctgtctagtagaatccaagtttccataatatttttaatatattgcctgaagaaattgatagtatttctcacaagtagaatctaagtttccataatatccattcaatactatggctcaaagaaattgatagtatttttagctagtaaaatccaagtttccataatattcagatctatgtaaaactgatcaatatcttctccactaccaaagatgtgggtaaaagagagatttttaaccaaaataatattatttttaaaataatttaccaaactaatgttctttcaaaagtatttacaaaaatactgtcgaaggcaaagtcaccctatgataggatgactttctgtactgactcagtacgtccaacgtcacattgagtagacgcattggacaacaaaaattgccttatgataaggtgacttatagaatcatcttaaaataggatgactctatgagttgctctctcatagaacgacttaacgtaacttagacaaaaaaaaaacccaacctccctcttcctcgttgcgagaacccccggtccccagcagccctccatcctcctctctgtccacccccctcttcctccctggctcgagaactctcggatccccagcgacccaccctcctcctctcaacctgccccacctctccctcctcctcccgatgcgagaaccctccccgatccccgacagccctctctcctctaagaaattttaagatatttaccaaaacttaactgaccgaggagggttctcgcatcagggaagaagagggagcgtccaacaccagattgggcagacgcattggacaataaaaattgtcttataataggaaacttatagagtcatcttaagataagatgactctatgaatcgccctctcatagagtgatttaacatgacttagcccaaaaaaaaaacaacctccctttttcttaatgcgagaactctcgatccctagcggtcctccctcctcctctcggtgcgagaaccctccctgatctctgacagctctctctccttcaagaaattttaagatatttaccaaaacttaactgaccgaggagagttctcgcgtcagggaagaaaaggggaggggggaaggccgagaagaggagggagggccgtcagagaccgggagttctcacattgagaaagagggaggttgttttttttttttttagctaagtcatgttaagtcgctctatgagagggcgattcatagagtcgtcctatcttaagacgactctataagttaccttagtataaggcgatttttattgtccaacgcatccgcctaatctggcattagacgtgctaagtcagcacagaaaatcatcctatcatagagcgactttgtctccgacagtattttagtaaatatttttgaaagaacattattttgataaattattttaaaaataatattatttttgtaaaaaatcagtaaaagaaaggaacaaaaaaataaggataaaataaaagtacatgagcttggagttaaagagaaagtttgcaatgctcacccttgttaggagggagagtggagcattccagatagaaggcttcgaaataagtggagcattatttttatttttttttaatatgagatggaacattctatccatatggcaggattggcaataggcttgatctatagccaagctggcagactgggtctatctttttcaaataatagacttcatgtgaatgccttctaagtaagaaagaatggcctatcatagatccatgcattttataggaactttttgtattattcatgagcttggattatttgttagacctgagaatatatttaggtttaaaattaagaaaagctggccttgatttgtttgttgtggcatgtttggaggaggaaaagtatctatgtggagattaggaggttgtcttttgttggagtatttggatcaaagatgatgtccaaaatatgttatttggattctttaacctgcataagtatctaagattaaatacacagtgcatagctgatattgactagacatacctccgcataggttcatatacttttttttcctttaaaagctttgtatccttactgaaagatattatttaaattcttgatcctctataaatattcaagatctatccagtatatgtctaatgtaagactaaatacatatgtgcacatgtcctcacagcttctatatatatatatatagtgttaaggatagatggatttgttttgtctttatatcttggtagggaggaaagaatagaaaaaaaaaatgggagagaaaatattaactttcttttgattgaaagtttttttataaaagaaaagaaaaaaaaaggagagaaatgaagagaatataaatcctctcaaatctgtaacttttttctcttccaaatcaaaaggaattagaaagaaaggaattaatagttagtgaattttttataattcccatcttacccgtttaataataaagattaaaattaatattacatttcaatcctaaagcttattttaaacctcctaactaagtctctcatcctattgaactcctgtggatggaaaaaaatcaacaataacaaaaggaaagatagaaaaaattgaaagataagatcttttcttgatttttttcttggatttattaggttttttttcaaaaatataatagtaaaagaaggttgtaatatttactttcttttcctttcctttttactttcaatcaataaacaaaaaaatatttttttttctttctttaaacttccaatcaaaaaaaaaaaaatactttctttcttttcttctctcctaactaatattttctttccttttcttttcttttccaaactcccaaccaagacgttagtgcccatgcggtaagttatgggggaaaaaaaaaacaagtattggttgtggtaaggaaccaagaaagtaattctttcttatagcggaggtagtttttaagactgagtgagactcttttcaagttagaagaatgcagaagaggacttgccatcgtggaagtgagcctctcgtgcattcaggttcatctcgggttatatatatatagtcttgttctctttaatggggtttgatagattcagcgagcgtgtgcaagtgcatgctagaggaaggctagggttgtgaggtctgatagttaccatgcatgcaacgaaggcaagcgaccttaaatcaatagctatatatatatcattaatttatatacgaagggagagtaataccttgaattgaacttggagttttagatgtcccctctggtgcaagcccttcttcctcgtcgagcttaggtggtaactgaggtgacgggcattctcacggcgggtccacatatatttatagtagagcataaaccaacttcccccctcgccaaggattctcccactttctaaaaaacaggttccgttctttaataagaagcaacagctagcacccagaagggcctcttctcacattgtaataaattagtcataccatctacgccggctgaattcatatgggaaggttacctccccttgttccattagccaaaaagaagaagaaaaaaaaaaaagacgccatgggatttgacttcttattctgatcttccttgagtagtcttttcattatttttttcactttgataatatgttgtagttaagctgggaatttcgaaatactttctcatcagattgaagattctgttttagttaactcttgtaaattatttttcagtaggcctattagataagcagtcctacaggaaactgtttagcgaacaccaaaggttttctgctactccatgttgcaggagatgaatctaaattaattctaaaaaaaaaaaatagtgcaatacattaatagagcagtaattaaatgtgtaaataatggatgacacttttaattagaatctatacacatcagcattatgtaagtttacggcaccccatttccacccttcacgccgccccttccataagatgcgtaaggggcctagaattaagctccctcacatggaaaagaggtgctaccatccgattattatatacccattcactgtatctactaaaagaactaattggttcacctagatcttctaaacaaagactaacccggcacgagagcaaggcaatttaaacatataaagacctacgggcacagaaattagggtaggataacaaggttgtgctagtatgctgctttgaaggccggctgtgcgacacaatgcaactttataattgttgtttcatttggcttaggtgcaaggatgaattgaaatgaataaggtaggacttgtgtcaacaagtgaactgcaattagaaagtaatgttgagatgggtggaaagcagctttgcaatacgaaaagaatggtctgcaagactgtaactggctatgaggagggcagacaggttaacttgctctcattcagatagcccataactagtgattaattaataggcactgcatatggatgcttatgtattgagaaccaagaaaggagaaacaacgagcgagcgaaatcacccagaatcttggtaacaaacccaagagcctaaacttacatattttacgtaatataaacacgtaacatgtatagactaataatgtggaccaatttaagcttgggtggagcccctataaacctggacccagcccaggatagctttggaataaggcatccaggcccagtctgaccaatagcccttcgacaaaagcatcacatttgcttgtgcagtggccttgcatctttctttctttctttctttgttcactgggaaaggtcctcgcatgggtttcctatgaattgcgcgcccaatccttctatctcataccaacgtatgtggtttgatgccgttccatacgcaagaatccatttccaggccttgacatagggtgaagcagaagactactctcttttagccgtgtggtccacagccttccttgcaaggatgctgtgtcttcatgctagtgtcgcttccacatcccattaagtcgccgtcgatgattgctacataacccatggcaaccacatgatcactgtatctcgtggaatgactggtgatccaaattcactctgtagctctccagcctttcatgttgacaccttgagctccaatagtatcagccgcgttttcttcgctcgtaaggttctttcctgaccgatgcaagagaagcaattggaataacttttccttttcccctcttcttctttcatttttttttttttttttccctttatttttcatgtcgtactagatgacgagcataggctaattgactctcacaacgagggtatatagcctcatcaaaattaccatagaacattctaaataacatccattcggactttgctaggagcatgacaccttcaaataagcggaagctggtagatttgcagcggcaaacgtagccgaacattcaaacaggttggtaattaatgccagagttatcacccctaaagttgactcaattaggacatttctgctgttatgatttggacttgaacctggatgacttaaaaacgacgtagatatgaatttgatgggctgacagacccactttaaattactatccagcatgtatcgggttctcttgtcaactctccttagatgcttcatgtatcttaggcgcattttataaccctacggatttgatttaatcgtctagcaccaaagtctcggagtgagaaaaatatcaactatgggacaataaatccaatttagatctgctctagtcttagcatttaaatgccaccatatgagtcaatctttcaaatccccggcttctcaaactcagtttactcataataataataataataataatagtaacaacaacaacaacaacaacaatctaacaaaaaatctaatgatgaagtccgacattaagtgatctagatacaatcgaacctggatgtgattaataaattgatctcatatgaatccaaatctttttctttttgtttcctttttgatttggagatcatcatgatcctatctttctctttgatgtactaaataaataccgtctacctacattaattaggcaacatttttatcaaactatgcttgctcaagtatgctcatagcttgtctctctcaatcatgacttgtcttgtcacgccccaaacccagcacctgagttgggcacgagacatggccacacaaccctagagcaatgtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgttgttgggccgtctgggctacaggcccaagtaactgggccgttacatgtctaacgaagcatggacatggtcaatcatggagtgtatgcctcaaaccttgcaactagacaatagatatatggaccatataagctagagagtccttttgggatctacatccaagtggaaggctttgattgacaaatcaaaatattcttaaggaattatatatccacatattaactatcaagtaagagctcatcatatcaataatcacaagaaacgacatggatttatattttagaaatctctaatgattctttcccttgcaatatcataaatggtattagcaagcttatacaaatagagagagtattctgtcgtcattttatggattatttcttctttcaacctctttaaccttagttgtacgatatacctataaccaagtatatgctaaattttataaacaatcccgtgccatttaatagcagctaattgtatacttatcatcattgactgatattgtggctgcacttgattggttgcctgttggtcactcgttacttaagtgtacaaatccatcacgtatggaaacattaatatataacggtgtgaacatcagcatttcttttcttgatttttcatcattcggatgcctaattttctatcatgatcaactctaaatggatagagaagccaatgaatccctgcttacacactacttggatggtaatggatctgcgggctgctctcagctaatcgaatgaaaacggtcaacacggaggagtcacacccagtcaatctccaaccagacatacatacgccatccttgctggggccccgccaccttggccaaccggagtccacgtggtggatgcatatttgtcgcggatccttcgcgttggccattctggaagatggtttggtaggcagtaagtaaccgttccacgcaataatttatggcgtttggccgacattaaggttaaggtcactgtgccacgttcccagaggacggtttgaaattttctcatgtcggtctaccgtagactatctattagatattatatattgttcataatttcgtgggggatatcctcgagtggtttggttgtaccgtcgaatccatgattcctcgttttttcctcttgcttggatgatctaacccatgacttgatgtggcaagctccagtcattacaagtgtcttggaggattactctctctatccattgttccttaaataatcacgtgtacggattgatgaaggccacatgttaggtggtgggcctcctcgtaatctaaaaaatttggatggttagaaaggattttcaatgttccatatgttgttttggcattgtttccatctatttcattgtcgatcgtcttctttattaaaaaatttcgagcattcctagaaatgagctccagtgggctagcagggaggttttcgtgttattcttaatattatcacgatcttttcttttgtggtatctgattgactatcacaatcaataagccaatcagctggctggttatctttcaaagcgtttgaaagaaatgcagtataccaaaaccgacacctgaacaataagaaaagaaagaaaaaataaagaccgacactatatgaagatatattattatacttattattatgaccttaaggtacatgactgagcaatgtccttgtgtgctagaattcaaaggagcagagaaattaaaaagatcaattggttatcttgccaatcaatttaagaggcagttcttgaagatgcttccggattttcagtaacttttatttcctatttttatcaaaaaaaataaaaaatcttttattttctaagcgtggaagaaatttaacatgacttttatgtcataactagaggcacatagcaacgatcttgaaagaaagcaaactaatacaaaacgatcaaccaatgaaaatcaattgatttatttacaatgatggctcagcattctgttcatttatccatcaaatgccacgaatctaggtttttaaattaatggatcacgccctttttaaggtatctttttaccgttcgtgttgatgtaacccccaatccacctcttttgttccatctccaacgcgcaaaatatctaaaactagctctcagcaaacgcgagcgcgtgattctatggggtccacagagagtctgacatggaaacggaatggtgcacgtgttcggtggacatgacagcacgtcctgtcccaactttctcaacatagtaattataaattctaaatttaaaataggattccggggacgcggcttccttatctccacgtcacacttttgtcgagcccctcgcctggtgatcatcaaaccgcgtggagatcagacggcggccgagccatccgacgcggagatcgggcggtctggaaaggggccgtcgacccgaatgaggtgacgcgtccgcgccgggtgccggagactcctcgcccccgcataaggacccaacctcgacggacctttccacgtgcgccacgtgtacagatatggtggggcccaccacaggaacaggttgttccgcgcggtcgcccgcctcgcccttgtcgccttccggttcggcgtttaccgcgcgctgacggcgtcgcagaggaaaccacacggggatttatcttgccggatccgcaccatccatttgtccattgggtgatgcaagggtggtacatgatattgtgtggagcgcaccaaaagtccagggcgagtggatttaatatgggaaaagggcgtgcttgttcaaggatggaaataggtttgcacaattcacacatacccccttttcctttaaaaattttcaaagtaatcctccgtatttccaatatgttacaaaatgatcccgctgttcatctcgttaataatgatagcatgtgaccttcacaagatatgataaatctttggaccaaaatgctctaattatcagttgtttggacaacatttcctacggccaccagttcatgaacgtcttccacatcattcaccttttaaactataagcttatggacaattccatttctcctatatcaagcactcctaaaagagagaaaaaaaaaaaaaagcaatctccatataatttgagaaacaacatctaccattgtttcaatctttgagaagcagcgcctttcaatttgacgcataccaattatctatgggggcataaacggtctaaataagtacatcaaaataaaattttgtatgcaagaccatcatggaaagttttcttgtggctcggagcttccacgctatcattccttaagtgccgatgcatgttaggttgacaactgtatcaattcagggaagcacccaactttggaactagaactcaaattttctgcttttctagtacaccatcccacataatatagatctctaaatttaagatataatatatatagtcatgctattgaaagatatagcccacaataacatgaaaccaataatcataatctcaaataaaataaaaaatataaattcatcatttattaaataattgaataaatattggttcagagcagttaaatctaaatttaaatattaatatacataacctcaaaatttagaaagtcaccaactacaaaattggtagtcaattaaagaacttgaattatactataaaattaccaaacagtctgcattatttttcatttttcaaggacctaattcatttaaaaaaagaaaagaaatataccaaaagaggtgaagtacacaagaattaataagtaaaacttacactattttgttgaatcaagtatcaaattttttataaataatacatcttttaaagaaaataaaaattatcgtaaaaaatataatttatagtatagcatgataaaacaagtaataaagccaatcacgcatatacaaatcatcaatatttcattgacatgattccaagtttatattgcaaatacaatcataaattattctttgtatttagtcacatcattatttagtgcattgctcatgaatattcatgttagattaatttatactagtgataggatcatatttcataatcgataaaatatgatatttcatataccaactttatacccattggctggccatatttcatattaaaccaatttcggaatccaatctttcccaattctagaggatagaaatagctatttaaaaaactttaaaaccttcatatcttttcttaaaatatatacataagtagaaaaggtaataaatgacatcataaaattcgtatttcataaaattctcagagcttgtcctcgtctatgctcaatgagaagcgattaaattaagccctatatacacacacataccatctagaaatgttaaacaaatttttaaaaaacatgaaaaaagagatgagaacttggatcaagaatttggagggggaggtggttatccagttggtgttagggttttggagggaagcagaaggattcttcctaacagctggcggaccaagcagtggtacagtaaccctatggaggagaagaatttgttagtggcggagccaggttacttgatgataacggctattcgacgagagcggaggtaggaagcaggacggtttctgaagagggtgagggtattttagtctttttgaaatggtgttggctggttgacggataataggatcggatggaaatattttgagaaatgtaaagggttattctgaaaatttgtaaagataagagggtaggcgtgagaatcgctaaaatgtaaagggtgaaactataattttattttattttattttatttcattttgcttggagtatatcgcgtcttgcactgggcaacagattccgcgaagcggctttgggaactcacgtggtaacatctaaacctttattttcttttcttttaattatggtggttgcctgcctgcttcactcgtaaaatcacgttccatccaacaaccgctattccgtagagcataaaaacaattttttttaaaaaaaagataaaataaaatattttttagataaagggatcatcagataaggatggaaagattcagctatttgggtatgaaggaaaaaccaaagctacttttcactgcggcagttccaaaaatattcagaatgaagagcatatcttgaagatagcaaaattaaagtaacctcaaactaaccaaaaccagcagcatgattaaagcaccggcaacagttaatcgactagggatacaagatatataattcagtgataagtaataaggtagactaatcaaaacggtctaacatactaaatgaatccaaatatatagtaaaatatgtatggatggtggagcagtagtgcacgtgagctctcaatgtcgcggagatttacagagttttataagaacttttcggggaactattgtagcatagtgtacaattgtacatatggttattaagattatatccatagacagtaaaagttttgttctttaatgtttgacaaaatgatactactaacttaaatttttaatgtcagttgagaatcattcatttgtttgctggtgtggattttcttctaaaggactgcatgtcattctcataattttggtaaatttaattaatagtcgaggaatccaattagttttcatttagttgcagaacatgcgaaatattccgttaattactttaaatgtaaggaattgtgaaagccatgttgtgttttcgccgccactgcacactccacggccacaggacgttctgtttccattagattattattgtatatttattaaataatttaatagcttaccgatatccaaaagggcattatagtaagtttacaccaccagaccaatcattatatacgcattccattccaagtccaacccactgcacgtcttctcagctcccaccgaaagaaaatattctcacattccgctcctcatcttcttctctgtttccgagcgctctttgaaaaccaattactaatggcttcggatgtgaccatgatggccgccccagatttcgtcaaagatgatgatgatgattacggcggcgtccttcgtttcatgccggacggcggcgacgacgacgacatcgggtataggcggatctcccgcctctcgatagagagctcggacggcaatgacgcggacgccgaggtatcggaggacgagaaggtggtgatgaggacgagcatgctggcgtcgctgatggaagaggagggggaggactccgacaaggactgggcgtcgctgccggggacgcctcgccggggaaggccggggcgggcggagaaggagtacgcgagcgagacggaggcgcggggtcggcggggtgggtgtggtggcggggggaggaggcggaggagggcgagggagcggtggctggaccggtcgtgggagatgaagaagaggatggcgggggagggggcggcggcggaggcggaggggatggaggtcggggagtgcagggtttgggtgcggccgagaggtggggtggggacgttgtgtatggacatggaagaggtgaaggcgtgccgggatctggggctggagctgcccagtgattggacggtcgagatcccgtgcgccctctccggatcggcgctggataccagcagcggcggcaattcccccatagctaactggaggatctccagcccaggtaagagcgagaagccccccatattctctctccagtctctctacagtgttgttttctgtttgccaccactaggactgctactattaccaccagtcgtgttctctgttgcaagaatttgatggacggtgatggagtgaggtgctgtcgaattactgtggaccgcagattgggtcgttaggggattaactgtgtacggcagagtggatcggacatggaaagacgggaagggcgtttagggaacccaatgatttcttgcatatgattgcacgagctaaagtagatcatgcttcaacactaagatttgatggggcctgaccacgatgatgaggatgacaagtggcagcgatcacgggattgtgatatttggcgatgatggtatggatagtctgcgaggatggattgttgcaaaccagagctagagtgacgacataaccatatattataccgctttaaagcgcacttaaaatttcgctggaactctgcaaagttgggagtttgtgtagcatggcacttattgaaacaaaaattagcatagggataaaaatgatgatgcgtaagaaatatatagtttaatcaaattttggaggtgtaatcttgcattgctaaatgtggcattgctatgttttcttctttgaagcaggcgatgacccgagggatgtgaaggctaggctcaaggtttgggctcaagcggtggcactcgcatctgcttctcgtctcagcagctgactcactcctacaaactggattcatatatatgttttcagtgttttgatgcactcggttttgagcattggattgcagatccgatctttctggctttcttatgtaaattcctttcttagcttcagcattccgtgtgggtttcccttcttcttcttcttctgtagataatgtggtggactattcgatgaaactaggaatagatagggggggaggagagagagagagtatagattatagcagggtgatttggtgattttccacatagctcactgacaaggctccaacccaagtagttgctacgttcggccattcaagcaacacgggatttcaagctgtggaaggagtggcatcctgggaggtgtatgacgagatagaggctcttgaaactaattctgcactgacactagcgatgagatattttgacctcgcgcccaggacagatcaagtacctttgtatcagcctttcgactcatatgtaattgataaaaaaaagatttttcaggataccgctctggtgctcagtctattgcctattcatttgcacacatgattgccatcaatgcgaaagtagtaccatataatggcagaaatctcgtgaaaaagatacagtggctgtttaactttttgattggtcaattcactgctctgtacttgtctagccttttgattggtcaatcaactgatgtatcgtatatgtttttttttttttgatgaaaactgatgtattgtttgttgtcgagtaccaacaagcagccttttgatgggtcaattagctgacgaattgcatcaagaaacatttaccaaacaagatgaagttttcaatgacacatctccatgtccatttgagaacggcgcagaagcattgaaccagctgtgaaggttcttcatgtataataaacaccattgttagctgttactttatatgtgtctctaagtttcttgagcatgtggttttctaggagttattttctttgggtcttattttgctattatgctaggaaaatgtaaagcttccgataatgaacctggaacactgaaaatgcccaccatatgacagctgaccggtgaaattagttttggacgattagaaaggaggggtaaaagtaaaacaatctccaaaaaaccaaaaaacaccatgcacctgtctgtttttgaaagaccagaaataaatagtagatgctttaatatatttctaagctcaaatctgttgagttctacaaagatacaattggcatatgctataatgatatctttcggatttctttgccttccatgaacatgtggaagaatcatttattggatgaatgcagaatccaacacaagttaatttcattgctggactctgggttacagcaagcaagaaacttacagacctctgtattcttttctgttggctcatgtctagttattatttcacctaaataagaatacgcaatgcttcaagattatgaggaatcatcaatggtaattcagtgccttctcctgaatatcagattgtggcaagtcctgtcacaagggaatgggcagtccattgactttatgctggatcgatcaaagtaccagtcaccaacagctgttgcaattctctgcacggtaacaggaaaattatgatagtggaatgatgaatgttctatcaattatatgaataaatggataatggatggaacaatgattttattgatggttagccaccaagagatgaatgtagagacaaccagcattctagagaattcgaaagttcattggtaacaaacagtcaaagcaaatctggtggtagtactggcttgatctacagaaacatccattctcgcactgtcatgataatgcccctttcttgatcaatggcttcatggactttatgatggaatacaggttttatgagttttatggaatattcagatgaccattttatctttcagctttctgaacccatttttcaaaggagaattgcagaaacagtgaattagaatgcaagttctttgatggcctgcgcagatcaaattcagtcatatttttaagaaatttaaataaacaaactgtttcagttggaaatttttctcggtatagcttacaagagtacctatggagaccacaaccagatgaccaaagatctcctgctgagagtaaactctaagtttggatctattggtctgattgtcatgtgaaaattattcagaaaacttaagggaaaagtaagaactcaaaagttaaaaatgtgataatcagatgacacgtcatgtaacatatgtctataaatgaaacttgtgcttacaacatgttcagtgaaaagcaaaaacaaacagtgactagtgtttttttttaaatgcaagaaacttctttattataacattaaatttgtttcattatttcttaattttttttcttctggtaattagatactccatcaattaagagtgcagcaagtttcatcaaaaagaaatcttataggagtgcaggcttgaattttacagaatcaaaaatggaatcaaacaaacagtcagacagtttcatcaactatacacttttttggggaaaaaaaacgtacaacttaatgctccctgacataagacagtaaattaaatctctacagagatttatgagttggacatgtcaataacatccattttcttttgccagataacttaagtacagtaagagaaggggaataatatgtaaatcatgagcagacaacgttgagaactgcttgaaagagctgtaaaaattaattcaaagggcatttacatgtataagttttcggtacctaacaagacttgtcaaccatactactcattttcactaaacttgtctggtgtaccctcttcacagcttaccattttattccagaaaacaaaatttccatatttttgccaagattcatgttttctccatgatatgttactatagtatctgaatgccaatctttgtttcatcattcttcattactcgcatctgaatgtcaatcttcgtttcatcaatatttcttatccttcaacctatatgcttccacaaatttaaactttgcaaaagttgcaatccatgagtgatatattggtctcttaattagtcatattgttttaaaaattggccataggctgctatagggattttgaacttaaaccactatgctatgtgctatagtgccttgtagcatttaggcctataacacttaatatagagggtaacaaactgccacagtggccaccatgcttttgggttatggtgggtgctatatgcaagagcaagtttaaatgaacataccttaatccttagcatgataagaaagttcaccaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtttgtttggatacttctacaagacttggctgaagatcctacaagaatcaagcctgctcgcctatctagctcatatctttcaagggcctgctaaaatgccagcccaaatcacagcctttgggcttcaagaagaaaaaaagatccatggaggtcattttttgttcccacaagatttggaccgagaggtgtttggttgatagagccatgcttaaatgaacggcccattccatgaatcccgcaagattttcagcccaatcttgtaggaatatccaaacaggacctaaaaaggattcggcaagactaagatggacttgatttgctaatttttggaacttccaaagtatgatgagtaagagaaagagttggtggttgggagacttcaagcaagatccaaaggataattctaagctccccattttggaagaatgtgacatttgctttgacatggtgggagcccttataagaagtgctgaggtatggccatcggttataaatggggttatttgatgaatgctaagaaggagatagctttccatttgaacaaagatggaaaaaaaaatcttccaatttggggattcactgattcaagatgggatgtaaaatgtaaaggcccattgcatagggcgggttacttcccgaacccttcttctatgctaataagaataaaattgaaaagttgagtgcattttaaagttcgaccctaatgatcagaatttgcaagatgaaatttcaagggagattcttttatacacgagctgcaggatcatttggaagggagatggccattagccaaaggtcttggcccaaacttactaatgtgttaattgttagtaacatgtctctgtgtcatgtgatatgaatattcttctgagaataattcatcttttaatcgatgaatcaaatatatgaagctaaaaacttattatgtgtataacttatgaaattaggtcagtgaggttttatagctttgtacttgatttgatgaaaaagtattgatttgatacttagaaaatatattgatatattttaacaacctactttgggtttgtaccacctgctatagtgcctgctatccactatttgctatgaaattccctagccacaacatgcccattagccgttatcacacttgacattcttgagtcatatcaagtaagaacaataggttttgagcaaggatttaggttccacagaaatgatatggtaccatcagcaccatcctgttctgataggatttgggaccacaaatctatgggacatcactcgattaataggtcaggatgccctccctgttctagccaatcttgttggaaccaacaagtgccaagtgcgatttggccggtaccaggcacgttccaatcaaattgcttgatttcaaaattaaaaagagagaaagcaatgaggggccattctctctctctttggcttagtgcagggggcaatgcaggtaaagacagagaaagaagggagagagagagagagggagaaaaagaaaaaggagaggacaaaggaggggaaggagtgcagatcctgcattcagctatcagcctgttccatcaagaaacctcatcaataacatgtcaatattcagttaaatattcatttaagacaaaagtaaacttgaacaagaaaaaaaaagtgtccttatacactaattggatgccagacaatcccaagtgttgggatgagagtattccatacaatcccgaacaaggaaaacacctaggtatttttaaatactcatttttgcacccttgcctacacccaattgctacagtatcattatggtacagtttaagtattgatacagtatgagaggcatatcatgaattgattccctactgatatattatgagacattcgatacagaccaatataatgcagcactcaaaatcatgaataccatagcatctgttaataatatgaaccatagaggtctcctaattgatttcaatgagttgagtttacaggaacagaaaaagagcagctcaaaataagcctgcaatgtacacttgtcatcattggaaactcaccaattttcccatcaatttatactagtggactgaagtcttgtacaaccctatgacccaacaaatatgtaaacaagacaagcttttcttatctcttctgtcataaaatcttccaaatttctatcattctacttccatgaacatggaagaatgatataagattattgatttgctgaattaacatgccatttgcttgtgctcgaatctaacttatagaaacaactaaaggatcatagattctcttatctgtcagctcttgctatttatcattcatcttaatgaactaaggattgtccttgtgctttcctctatgcttctctggttttctcttgatgttgactgctcttgtcacaagggtatggacagtctattgccttgacttcagactaattaaagaaccagtcaccgctagacattaaatcccctgcttgctaaaagccaattcataattgatgggcttgaatagggagttcatcatctacttgagaaaaataggacataggatctgctttcatgaataggaagctaacaataaaggcatgataataaggctcagttaatatcttttttcttttagatgatggagcagagtgattagcagctttcctaactactaataacaggaaataattgtaggagcttttctcatggtctatctatctttagtttatcatttgcaaatattcttttatcaactctcataagtagttatttctggaggattaatatattgatctagttcacaaagatgaaccttcatatcgaataaagaatttttggcttttgatatttcaaatagccagtcaattctccaccctttcaaccatgttaaagaaatgcatgagcaacaaaaatgccatgtggatgagaaactatatatgattttgtttaggatttgttgacataccataacatattcccaaaaaaattgaaaaagctttctaaaattccacaactgtctccgcatggttccataagactaaagctgcagctacatagccacacatctcctagttatgggtaagtggcaattcaaaagatttggacagcttatggttcgaacattttcatacatcgtatgggcaaaactgaagagaaagataataagtccaaaaaatttaggatcggagtacatctgcttcagcttttatctttttccaggggtacgcaaagtagacagttcagaaatgaaaggtatggtcataagcatataaaggcaccactccaaccagggaacaatatgctaccatgatgagatgttcagttcttttcaccatttattctataaactttccttttccctcctatctttccttatgagtactgaatggaggtattttagcaaggaataaagcagtttgataaagtaaaccagaagaaaatttcaaatggaaataaaaaaatccgtagtttatggaaccttttgtcatggggacagtagattgcagcttcaaacaataatgaggcccctaaaacactatccactttattatgtgagggttgcaaaagagagtagttgtaatggctggaaaatgggcaatggcagctgtatgaacatatgtaactctccttgcaccaaagagagcccaaaagaagtttgaaggatcatcaaaagctaacatagcactagcagtcctgctttagtggctactctttaaagctactttctatgttcttgtgtctcaatgattatgaagaatgtctaacatatgatagttaaactctgtagataacccatattggctgccattactggttttccatgttgctctctaatatttgaaaagcagcgagatgagaaaagtacaatgatgaaacttatctaccatatttatattcaatatacctgtccttgtcataatctgctggaagcttcacatgatctctatcaggcgtcacttcagaaataaagatcaaagccatgtttaggttgttcctcattgcttacagaaagttccctttgttcatatcattttgtgattttttttgaagttcttctattttgcttggattggcacacttttatcatcagattggcgtgaagccaatttggattaatgaaattcttcttatttgcctggataccattggacttccatctaaatttctatgatatacttaaagacttcataagttcggcttaggtgataataggttcgctgaaccggtcccgaggctggtatcggttggcgactagcatggtacaggtctgtattgtcccattctaggatgaacttttttttttttgctgaattcaaactgaagttggcaaatagtccctttttttttggcccatttggaaagtgaagtcggcaaaccatgagagcttaaagcccatttgccgacttcagtttcaaattggcaaaaaaattacaaggcatctcctatttccaaacgaaacaggagaaccccctattgacaagccatgagagctttaaagccctcgtcccgcacccccccgtccctctccctccctctcttttcctctctctccttctccctctccctccattttgaatcagtgcattgaaccgtgccagtaaccaaccagtccaggtcagggttccgaatcaatgcactgaaccatgctgttaaccgatcaatccagtttggcactccccaaactggccagtttggcatagtgcaacaatccatgagtgatatgatacttatcttagtggcttattctttttaaaaatatagctacattcaaatagtgtttgaaatttcacccacggaaggcacacagatgcatgaatatactccaatgtatcatgttacaacaaattattctagtattcaaattgaatccaagtagttttaatgtatgataccttgttcccgataaggggagaattacttgaataccatgtgtcctgcctctcactttggcaatgagcaaaacatgaatttataaataacccattttgcccgtacgtggagaatccttttacagcattaagcatttgattccggaaccctgcattatagaaagcagccatgtaaatggtttacctgttttacaaagccaaagctggggaagagaagaaaatgaataccttgcagaacctggatttgatatgcatcacattttgcataattcattttacattctcgccagtaaccacgaggatcagctgttctgggagctaaactttcctgaatctgcaaattcagaagcagagaagaaattgttagagaaaatagaggtgatctagttaaccttaagtttgcaccactcattaatcaagggttattttgaagtcattattctgaaatatgaaaacttaataagaaaaatttacatttgcagtcataggctcataactccataggttcagtcacaggttccttaagtaccatttcagtatcaaatgagaacatttacatgcttttaaggataagaaaatacctgccatacatcataggctgtattcaaaagaaaaagtggggtccgaacattggccacaatgttctgtggaaagaagcactgcaaagagaaaatatggggaagaaaaaaaaaattcaaaacaaagcatttcaatttagttgttgctactagtcatccatctatatgaagaaagtaaattaccgaagttgcatccatgcgagaagtacaagtccttggcaagttctttgccgccccctgggtagtcatgagagtttttcataaacggaatagcaatatatcagaaatgagctaatagttaattccttacaactcaaacatatatcacatagatacctgaaagttcacaacacctccaaagaaggatctcagggttcgcccacctgctacatcaactctacaaattgaacacaaaatgttatcagcagaaattagagaaaaacacagattagaggtgtatttagcaaataaaaaacatacattattaaaaagtttatgttcaaatacagcaatgaatagtggatgcacataacttagacaagagatgcgagagtaaaattaattttgtcaagaacatacgcatcaagaaacattccggcatcaccaaggcacttgacttttgttcttcttggaaataatgctcgaaattcatcacagtgtagaatggatgctagtcccccagcagaacaaccagaaagaagggcctgaaagcattaatataatatattcactgtagaacttgaaccaagatcaagaattcaagatcacatcacatgaatagggtaagaagacctggttggcataacgcattccctttgacattagatcttccatcactgctaaccagatacgctgccctcgaaaatataggccagcagcctaaaagcgatagagcaatattttcatatctctgagcatatactaacaaatatttatcgggcaaagacttcaaagaaggtgaactattaaaatctcagaagtcaaaatgcatttgatagaaaacagtaataacagaaattgaataaggccggacatagcttattgaaagcattattccttgcagatgatatgatgcagcttaattcatcttcctgtaaacactataaacattcggaggaaaatttcagaaattgaaaagcatataaacagtcataattccagtactgcacgatgttatcaatccgtaatatttttccccaaaaccagcttcatgagctgcagaggaaattttaaaacctttccataatgtatcaagttgtaaattgcaataaggacattttcagatctctgaaattgcaccaaggttgatcttgagaagtatagatcacctctattgggaaaaaaatggattcaagtatgggccacaattaataactttcatggatcatctcttgaaactatactatgctttaacctttaacaaaagaatataacatagaaatctcaagttatgaattctggtagaaaaagaatatagataagaaatattctttttatgtaaggaccatcacaaaagccctatatttctctgatgtgatgatgctgaaataatgatgatcccttatataataggccattggcaactcttagaaaatgcaaattgggtatccattatgagataggcagccagttagaaagctgagaatagaagtaggaacaggagttggagctatagcaagaattagatatattagagggaacaatcaactctattccttgtaatgtcaagtggcaatggacatggtggtgcaacagagggtgcagtcagggggtaggatgaccaactggaccatcccaagtttcacatgagctagaggattttcaagcaaatattttgacaagcaaatatttgattttatttcagtgggattttcctataaatttttttattggagacaatatcctattgcttgctaggtttctacttttgtagttaaataattttagcatgtttccttcttattaagtcctatttctagcacaagtttgtagcagttttaatgcccaaattaggcatcatatcctatatgtgcttctattacacaatacattgtatgaaggagggctttttatattttaataaaatttctcagagatcaaatgcccttaattgataggttgatcttccaagcttaagcatggggatcaaatcactcttcactcttcatgctgcatcaaatggcatgaagttgcaatctagtttgagattggtgccataccatagctatcccttcataatactgctaaacatctgataaaaattgttgtaggatgatgccatgaggtggaactgtgtattctaagaaaagttggaacagattcatgggtccagaagaaataaagaccttggcaccaaacaagtaaaagagagagcttcttgtaatggagacttgttattctttccatacataactgcagtcccctaattctgaccgcacaatcaattccatgaattatatgaagaaagttgcattcatgttcattattttggtgtgactgttgattttctgaaaagtacctttggagttctagttccatgtagtgtaccttctacactcatcagaaacatgatgacatttgcaaataacatgccacatcaaaaattcatgcatcaataacaaggacttgaagtttcagggaaaactctaatcccttaataagaagtttgaacaactgttactcttccctcatacccattctgtacctctcaaggttcgtatgcattattttaatgcttccaagtaaccctttggatttttgtttcttcttaccatccatcaagtaggatctatggtactctgagtgcacgtatctagtataatttgaaggcttttctctttgttctagagacgtcctcatgacaaacttgaataagataaccacctcctctgttggtctttttggcaggagcaaccttacctgttcttgttcctgtcagttgcacccaacagttgcttcacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctttttttttggtatactaagaatgtgacctgttacggtggtaccgtgaaaatcttagagttatgttatcaagatatacttcgggccgccgagctatcgctgtgactcccgacctaagcacagagctaaggtatacggagccgagctatctacatcctatccactatatgatctgttcagcacaagagctgccttcgttatctcgaccaacgaatctcctgacacatacagcagctgtccaccttaagtagataagctcataggtaaccacctctcctaatttcatgggagcgattaaaggctaaaatatctcacccgtaatagcatgttcaacggccctgcaatcttgggattgtacgatttcacagttgttcaaacaactgttcgataatattctacataaacaatcaaagctccgaggatcaaaataagcaatccctctcagagaatccattgttgctcctttgttctctgatttctgacttgagcatcggaggattctcgtcggagcgaaaatctttggctcggatttattttgcaagtcgttccagcatccctatgcaagactcagtcacctgttttccaacctccataagaacgagcagcaacagatagagaaaggatcaatcttcattatgccaccaaaacgagtatcattctgactctctaatgccgccacctttcatcgggcggagagctaggccaacagccaggtgcagcaaccggcgatggagactctatcaatccagccaacactggttatggcagaccacttcaatctgctctttcagcaagtccaaaatttgatagctgccgttcaagcagtccagactgttcttgtacatcctacaacagcgccacagcttgctcagactgcccctgcacctcttttagcagtgcagctagtgattttctcaatgccaccagcgcctcccgcagtgatgcccccatcaaatccgactccacattcggctcctcagctgctaccacaatcagagctacatgtgcttcctcagagttcggaaaggaggcagacccaccaaagctgtcacaaggcctaacaaccggccaggcggtaatctcttagcttgcgatcagggcatggttcaatccctgatcaccattctcctcagcattcgaaggcttgcaccatttgcgatcttgctatagagaggaaattccaggcaattgataggtggattgatgccgccctcaacaatactttctcggtgtagccctacaatggattcaacaatgagccatcttttattctgaggatagtgcaggagccgctccctcaatacttcaaggtgccataatttgatacctacgatgggattgtcgatcccatcgatcaccaagagacattcaaggtggcgatgctccttcaaggggctacatatgtcatcatctattgagcatttcctactatccttaaaggggcagctcgacagtagtaattcgagcctgaagccggcttccatctactctttagaagagctaagctggtctttcatcgatcattttatcagtagccgacaacagtaaaagtgatccgactacctccacaccattaagcagaaggagggaaagttaatccacacctttatcagccgtttcaatatggcaactttagaggttcatgatctgaatcagtcgattgcgatggccgtcatgatgagtggtctactgaagaatgacttaaaaaaatcattgaccaagatttatcctcgaaatttttccgacatgcttgtccgtgcagaaaaatatgcttgtacgaaggaagtttttgcggaggagatccctgccagttttgttgcagtatgatgaaataaggagcgctctccaagatgggaggggagaatctgtcaacactcccagtccccaacctagaagtgaaaaaatgggggccataattatcgatctcggagtcctcggagaaagaatcgacaaccctcacctccaaggtgttatactaactacacgtctttgactgtttccaggagaaggtactgatggaggtacgagccgagctgcctcaacctccaaagttgcggacgaggtcagagcactaccgtgattcgaataaatactgcttctaccattgtgaccacggtcacgacactgaagattgtattcagcttcgggatgaaatcgagaggctcgtcaggcaggagagattgaatcattttatctggaggggtgtatcttaatatcgacctctaagggctgaacaatcacatcctttgcctcattaactgttctctctgcctcagcctcaatcgcagccagtaccaatgcagcaggagaggcaagaagtagggggaccggtggcagcagaagaccgacccatacagagagaaatccatatgataatcggggggtcgtctgggtcagcgaagctttcgaaagtgaagaaggcaaagctcgaggataggcatgaggatgccatcatcttcaccgagcaggatgcagagggtgtgctagccccacacaatgatgcagtggttgtaatcgtgaatattgttgattataatatgcaccatatattcattgataatggaagctcggttgatgttttatattattctgtctcttccaaatgggattcacttcggaccagctaagtaggttcgatacccctatttaggatttctccagatgttcaataatttcagaggaaatgattaagctgcctgttatcgtgggcacaccaccacagcgaacgacgatccaagtcaacttcctgatggttaaacttccttcaggctataatacaatccttagccgtccaagtttgtgaactttaaaggctgtagtatcgagctatcacttgatggtgaagtttcaaactaagaatggagtaaggcatatccgaggcaaccaggccatggctcgctagtgttttgctgctaagcttcaagcaaaaggctagccatcccaagcaaaaggctagccaaacctgaactttcgataggactggaagcccgagatgatctgtccgaggagcgtgcctagccatctgaggacctcctcgagattccatcgaggaaagagaaccccaaccagacagtgaagatcggctcacacctggacgaggtaaccaaggctcgactaaccgctcttttacagaaaaatatggacctctttgcctgatcgactgcagatacacttgatatagacctagaggtgatgttctatcatctgaaagtggatctgacttgtcgtctggtgaagcaaaagaaacgaagctttacccaagagcacaaaaaggccgtatctgaggaagtagacaagctactcaagattggcttcatcagaaaagtaatgtacccagactgatgagcgaatatagtcttgatcaagaagacaaatgagaagtgacgtatgtgcatcgacttcatcgacctgaacaaagcatgtcccaaagacaattatccgttatcacagatcgaccagctggtggatacactttttgggcataagcttcttagcttcatagatgccttcaccagttataattagatccggatggtgcccgaagacaaggagaaaacagtctctatcactgaccgtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacgtcaaaaattattatatttacgatgaaaaatttatgtcgctaatactttttaaatttaatttttataaaaatttttaattaaattaatagcgatgcataagattcatcataaataattattttttattagtgacaaaatattttatcacaaattatattttttatgatgaaaatttttcatcgtaaatagttttcaaaaaattaattttttttcatgataaaatttttttgtaggaaatatccattatttgtgatgaaattttttttctatcgtaaaattatcaacaatgcgattatttatgtctaaatattagtgataaaaattttatcgctaataactattagcgacaaaaatcgattattagcgatgaattttttttatcactaatatcctattttattgtagtggtgatgccctttggcctaaacaacactgggactatctatcagcggttagtgaataaaatcttcaaagactaacttgatcgtaatatagaggtatgtatggatgacatgttggtcgagagtcgagccacttcaaatcatattgctgatctctaggagaccttcaataccctccgctgatttcgaatgaagttgaactcagcaaaatatgctttcgaagttattatcggtaaattttttggatttatgatctcacgaagaggtatcgaagcaaatttcaagaagattaaagcaattcttgagatgacgccaccatgaactattgaagaggtacagcatctcatcagtaaggtcggtttgctcaaccgctttttcaagttggctgaaaggtatcttcttttcttccaaactctcaagcagtcaatagactttcaatggattatcgagtgccagaaggcatttgaggagttgaagcaatatcttagctctccaccactgctcgcgaaacctcagttgggtgaagagctattgctgtacctcaccatctctctagtggcgattagcgtaatcctcgttcaaaaagaagaacggatgcagaagcccatatattacactagtaaagtcctttatgatgcagagaccagatactccaagctggagaagctgatctttgcactggtcgtcacgatgaagaaacttcagccttattttcaagctcacactattgtgctgcttattgatcaaccaatcaaggccgttttctattgtatagataccttgggatggattgcaaaatgggctctagagcttttagagttggatgtgcaatactatccgaggccttccattaaagcccaggtgcagcagacttcatcttggagtgcaccatcctgaatagacaaagctcagaagctggagaaggtccaaaaggtggagagagctccaaagctaagaaaagctcgaggagtgaggaagtggatgcagaatctgatcttgaggagttatggacgctgcatgtcaatagcttatcaaatgcatctagagcaggggtcgagattatcttaaccggttctaaaggagatatagcaggatatgctctgcgctttgactttttggctactaacaatgaggtagagtatgaagttctgattgctggcttcaaagttgtaagagaagtaggggcttaacacctgaaggtcttcagcaactcccaactagttgttgggcatatcaagggtagatacgaggtccgagagaagaatatgaaaaaatactttcagaaggtaaatgatttgatcttaatctttttgaattttgatattcagtaggtctccagaatagaaaatgctaaggcagatgcactattgaagcttgcggctttactacctgctaacctaaaaaaggggacctattttaaggtattaaagaccactagcctcgaagagcctcttgtggcccagcaaattgatgaagaatcctgttcgatcgattctctactcaaatatttgaggtcagtcgagctaccatctgatcacaggaaagtttgaaagataagaaagcggtccgctcattatattttgtatgatgacaagatgtacaaacagtcattctctctatcttttttgaagtgtttacacccgtctgaagttgattatacactgcggaaggtccacgaaggaatctacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcttaaatctcaacggcctttgatcagccttaattcaaaatcggcctagctactgttagagtttctttgctcgaagcattcctactttccatgattagaactaagttcatggcaaagcttaatatcttaagtcagttcgtgtgctgaataaaagtgcacaatcacaaataaaagacagaggatatgaagaaaaaataaagttcatttcttcaaaaatttttacaatgacctcaaaaggttcaggtacaaaaaaaaaaagataaaggcctataaggtagcatcgggagctgagacgtccgtcgcggatacatcggctgcagcagattttcaaagtttatccaaaaaattcagatttaattctggatacttgacagcaaccgtatcccagaccagttgcttcccaccggcataggcatcagcaaagaactcaatcttctcatccttatactctattgatgcccgaaagtccgtaacagcccttgaggcggcctctgctgccttcttctctactgtcttgctgcagctttactcttctccaattgggcttcaagctcccttcttctcccttacagtcgagagttctcttagctcctctcagggccattttgacatcttcagctctcctttcaatggtgtcggccctcattgaggctttctagcctcccttacagctttgtctttggtgcccttaagtgtctcgacgttggcttggtgcttccttgcctcgactaaaagattgcggcagctctccatatgcccattcagataatggacgagctatcaagagaaatctcttattagtgcacataataagtggatgtttaaagtaaacaaaactacaaaagcttcaacttatccgaatgaagctctctacagcttttctcctcaccttcctgcatggttcggccagtagcttggttgcatcaactgagaggagcatcctgatgaatggctcatgcgccagctagtagccctctaagatcgaagtctcgagcttcagtgtagctggcatggccccagaagtctcagcctcattggctggctcatcttctagagaaaatgtgatgataggaggagccagcaagctcgaaattgtctcctcgagaaccaacaggctaaaaactgcctcctcagtggctcgactggtttggcttctttgatttccatcagaagctggtgaagtcgagccagattgaatcctcatgactctgaagttgccggcacgaggaggctcaggaccttctggcccaggaattgacagtgtcgggggatgtcttatcttgatacgagtactccatccatgcataggttcagctatcctctttctttgggctttcttctccacctctttcaataaattcaagtccatctctgcaactatctctacaaccaaggcaaccaaatggttagcataagggtaaagtaaaaattaaaaaacacatggctctgagacaggtgacctatgcataccttgaggaccagcttggctgaagccggtgttgaacagtgtctgaaccgacataacctgcttcagcatcgggaccttgaagttatgcagagcctccatctcctgcctctggcattgatccaacaaaggttcttttagcacagcctcttgaggttcaccccaggcaacgaaaccccagtcctcatcagacgtctgagagacaaagaagaatcacttcttctagtcgtggacagcggtaggagcatcctatatcaatggacggacatctttcttttttcatgtcatcatgtaccatcacccatgtgaatcagaatacctcttgaggttgaagaaagaaaagaagagtgtgatattgagatcaaccccagctaacatgcacgctacggtaaaactgcaaatacgtcgccatgagttcgggacacgaatatggcgacatctcaagatattggaggagagctacaaagaagggatggagaggaagcctcagtccagtccagaagcattccttattgaggcttatccagcttcggagagatcggcagactcgatcatttggtctcagaatttttagttggaactctaaagggatttaaaactactcatgaagtaataccacgtcccgctctattagctcgaactgaaattctagtgggacgaaatcagagtctctaaagaccattctccttgcaggaagagttttggaagcaaagaagggctctagaagcaaagaacgaaggagaaaaaaaacctacagtgaaaggaaatagggacgactaggaaccctaaaagtctgggcttggtcttgtctgagatcttaaatagacccagggttcaaatcatctccaaacaatgcttctttttaaaacattaattattggtggtatgaatcgacagagtgtgaacggacgcttgacgcatggcaaccactgatggaatattacctctgccatggatatggtagttaatgccagcgataggcaaatcatactttgtgtcacttttcaagagacatgcgaagacttgcgatggtacctgccatatggaggtgatttgaactccaattcttctaatgcctacataacagatatgaattatatagctcggattacagtccagattgtggctcaagtcgtgctttgctcagaatgttgctcagatcatgtatttgctaaattatagctcaaatcgtattttgtgatttcaattatggctaagttcttagctaatacagatcagaactcaaccaatatagctcagaatgtgatttgcactaattcattcaaatacagtgaatgttatcaacaaaaatgaatttcattcatttacatctaaaattggctacatcatctgggttacaaaaagaaaaaaatacatcaccaccccagagcatcgtcagagcgacttgctccagagcagtcttctttagtgctggtagcttcctcaatttggactgtcgcatcgaccttatttgcttcagtagagtaatgagacgctcttgtaaatttctctacgctatccaccgtcacgactttcaagctttcatctaaaaagttgatttgtagaagctcgatactgtcagtaggaaaatgtgcttgagccataattttacaattttcgaagcccgcatagaacgccatcttgtaagcctgatttatgatttcggctcctttttttgccaatcgacctttccttcttttagcactcgtagccagaatctcctgatctatgagtcagcgccaaaggagatcctgattctctctgttctcctttagcttcttcttcaagtgctttgcttctggtgaagtctctcgaagttcagtagacggcaccaaagatatgtggatccctttggaagcagagcccttacccctctggggtgttttcttcctacagcttgctctttttgaggttctgaccctcttagctgagcttctgctaggactccttgaaggatgaacctcagaagaagtataatctcgacctcttttccctcctagtgtcttcctcaggcatctctatatcatcacgggtttgacggcaatctctttcagtctcagacctctgcctctcgagatcattgatcttcttttcagtcttagatctctgtcgtttgaaatcttcaattctcttctcagctctcttcagctcgtcgtcccgatagtcaatcatctctcgagcttctcgaagggcctcttcagaggagttggcttctttaaccaactcgacgttagccgatctctcttgctccaagagatacttcagtaagtctattttttccctcgctgctgtaagctccagtgttaatgcatcagaggtggggccaatgaaattggctagataatgcccaacttatatacatttatatgaagtcgttggatgatacaagttatagaagacttaaaaaaaaattcgaaaaccccttacttgggcgagagatctcagggcacccttcatccactgttgagccccttgttcatttaggtactgcctcttaacaggagagaagaagcccctcagaaactctaccgcggatggagcagaagtcatcaattgcgaaggtcctgttcgaatgactactaggggagggcactggattagaagcgtctaccccaaagactttccagcctccatcgttatcgccagaacttcctcaagatggccagttgtgtccaccactggtatcttctccatcggtctcttctatgtcggaacctcctctagtggagtttttcccacaactttcaatagagaaaccatgggctcagcgatcaaaagaggatcttcatcgctcacgaccacgatagttattctagcagccagaaccctaacatcgccacccgttgggactggagggccaatggatgaaactttggcttgcttcttcctggccaataccagttcaagctttctcaagtactctggattcatcttgtctccgagagttacaacaaaaatctgaagcaaaaaagccttacagtcatcttctctatacacccgaagggcaaatttaaaagaagacaaaggtgaagataaaaagctgctgctagaaaaattaaattcttgagaaaattgtcagctatatggtcccatcagtcgtgatcattcccagcatactttcgtctatcaagctgacatcatcaactttaaatgctgagggcacgtatgaaagcgcaagagtgcgcatcctttgatccaagatatgatttttgagatacttctttcatctgattcttagactcaggaatagagaggtagtgttatagtggtaccgtagatacctcagatctgtatgttatcaacatttatttcagaccgtcgagctatcgctatggttaccgacctagcacagagctgagatatgcaaagccgaatgatctacattatgtccactgcgtagtctgttcagtatgtgagttgcctccattacctcaacaaataagtctcctaacacatgcaacagctgtccattctaagtggataagctcggaggtaaccacctctcctaattttacgagagtgattaagagctaaaatatctcgtccgcaatatcatgtttaatgatcctataattttgagattgcacgatttcacagctgttcgatcagctactcgataacattctatataaataaccaaattttcgaggactaaggtaagtaacccttctcagagaacccattattgttcttttattctttaatttctgatttgagcatcggaggatcctcactggagcaaaaatctccgactcaaatttgttttgttggtcgctccaacattcctgcacaagatttagttacccaccttccgacctccacaagaacaaacagcaacatgacgtaaatataatatttgaatgtcactcaatttgatcaagaaagagtattttaagataataaaaattgttaaagagataaaaataaatattatcctaccacattacctaaaaaattattacataatttaaaatattactacaactttagccctaaagggtcggggaattgggtcatggacctatataaatataatcatattattttgataacctttggcagttgttagattttcatgattatcttgatgcacggtccttagaaatgctctcttgtagtcaacttgactaaagtatttgcttaaatcatcataaattcgaagccatattttttaaataattttggatgttcaaagaagcaatagattatgattattatttaaaaaattgatgtcatatattttcttaattagtgctatatgcttctttattttttcaatattttttaattttttaagcaaaaaggtatgtttgttttatcaaaaaaactttaaaaatttgtggccgctgggattcgagcccaggtctccacgaccacaacgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttaaatctcaatggcctttgatcggctttaattcaaaatcggcctaactactgttagagtttctttgctcagagcattcctacttcctatgatcaaaactaagtttatggcaaagcttaatatcttaagtcagttcgtgtgctgaataaaggtgcacaatcacaaataaaagacagaggatatgaagaaaaaacaaacatcatttcttcaaaaatttttataatgacctcaaaaggttcaagtacaaaagaaaaaaagataaaggcctataaggtagcatcgggagctgagacgtctgtcgcggatacatcggctgcagcagattttcagagtttatccaaaaaatttagatttaattctggatacttggcagcaactgtatcccagaccagttgcttcccaccggcataggcatcagcaaagaactcgatcttctcatccttatactctattgacgcccgaaagtccgtaacagcccttgaggcggcctctgctgtcttgctgcagctttactcttctccaattgggcttcaagctcccttcttctcccttacagtcgagagttctcttagctcctctcagggccattttgacatcttcagccctcctttcagtggtgtcggccctcattgaggcctttctagcctcccttacagctttgtctttagtgcccttgagtgtctcgacgttggcttggtgcttccttgcctcaaccaaaatattgtggcagttctccatatgcccattcagataatggacgagctatcaagagaaatctcttattagtgcacataataagtggatgtttaaagtaaacaaaactacaaaagcttcaacttatccagatgaagctctctacaacttttctcctcaccttcctgcatggttcgtccagtagcttggttgcatcgattgagaggagcatcctgatgaatggctcatgcgctagctagtaaccctctaagatcaaagtctcgagcttcagtgtagctggcatggccccagaagtctcagcctcattggctggctcatcttctagagaaaatgtgatgataggaggagccagcaagctcgaaattgtctcctcgagaaccaacaggctaaaaactgcctcctcagtggctcaattggtttggcttctttgatttccatcagaagctggtgaagtccagccagattgaatcctcacgactctgaagtcaccggcacgaggaggctcaggaccctctggcccaggaactgacagtgtcgggggatgcctgatcttgatacgagtactccgtccatgcatagattcagctgtcctctttctttgggccttcttctccacctctttcgataaattcaagtctatctctgcaactatctctacaacaaaggcaaccaaatggttagcataagggtaaagtaaaaaattgaaaaaacacatggccctgagacaggtgacctatgcataccttgaggaccagcttggctgaagtcggtgttgaacagtgtctgaaccgacagaacctgcttcagcatcaggaccttgaagttatgcagagcctccatctcctgcctctggcattgatccaacaaaggttcttttagcatggcctcttgagattcaccccaggcgacgaaaccccagtcctcatctgacgtctgagagataaagaagaatcactccttccagtcgtggacagtggtaggagcatcctgtatcaatggacggacatttttcttccttcatgtcatcatgtaccatcacccacatgaatcataatacctcttgaggttgaagaaagaaaaaaagagtgtgatattgggatcgactccagctaacatgcacgctacggtaaaactgcaaatacgtcgccatgagttcaggacacgaacatggcgacatctcaagatattggaggagagctacaaagaagggatggagaggaagcctcaacccagtccagaagcattgcttattgaggcttatccggcttgggggagatcggcaaactcgatcatttggtctcataatttttagttggaactccgaagaaatttaaaactgctcatgaagtaataccacgtcccgctctattagctcgaactgaaattctagtggggcaaaattagagtctctaaaggccattctccttgcaggaagagttttggaagcaaagaagggctctagaagcaaagaacgaaggaggaaaaaatcctacagtgaaagaaaatagggatgactaggaactctaaaagtctgggcttggtcttgtctgagatcttaaatagacccagggttcaaatcatctccaaacgatgcttcttttcaaaacattaattattggtggtatgaatcgatagagcgtgaacggatgcttgatgcatggcaaccactgatggaatattcccctgccatcgatatggtagttaatcccagtgataggcaaatcatactttgtgtcacttttcaagagacgtgcgaagacgtgcgatggtacctgccatatggaggtgatttgaactccaattcttctgacgcctccacaacagatatgaattatatagctcggattacagcctagattgtggctcgagccgtgctttgctcagaatgttgctcagatcatgtatttgctaaattatagcttaaatcgtattttgtgatttcaattatggctaagttcttagctaatacagatcacaactcaaccaatatagctcagaatgtgatttgcactaattcattcaaatacagtgaatattatcaacaaaaataaatttcattcatttgcatctaaaattggctacatcgtctggattacaaaaaaagaaagaaaaatacatcaccaccccagagcatcatcagagcaacttgctctagagtagtcttcttcagtgctggtagcttcctcaatttggactgtcgcatcgaccttatttgcttcagtagagtaatgagacgctcttgtaaatttctctacgctatccaccgtcacgactttcaagctttcatctaaaaagttgacttgtagaagctcgatattgtcagtagaaaaatatgcctgagccattattttacaatttttgaagcctgcatagaacaccatcttgtaagcctgatttatgatttcggctcctttttttgccaatcgaccttcccttcttttagcattcgtagccagaagctcctgatctatgagtcagcgccaaaggagatcctgactctctctgttctcctttagcttcttcaagtgctttgtttctggtgaagccttccgaagttcagcagacggcaccagagatatgtggatccctttggaagtagagcccttacccctctggggtgttttcttcctacagcttgctctttttgaggtcctgaccctcttagctgagcttctgctaggactctttgaaggatgaacctcagaagaagtataatctcgacctctttttcctcctagtatcttcctcaggcatctctacatcatcatgggttcgacggcaatctctttcagtctcggacctctgcctctcgaggtcattgatcttcttttcagtcttagatctctatcgttcgaaatcttcaattctcttctcagctctcttcagctcgtcgtcccgatggtcaatcatctctcgagcttctcgaagggcctctttagaggagttgatttctttaaccaactcgacgttagccgatctctcttgctccaagagatacttcagtaagtctatttcctccctcgttgctgtaagctccagtgttgatgcatcagaggtggggccaatgaaattggctagataatgcccaacttatatacatttatatgaagtcgttggatgatacaagttatagaagacttaaaaaagaaattcgaaaaccccctacctgggcaagagatctcaaggcacccttcatccactgttgagccccttgttcatttaggtactgcctcttaacaggagagaagaagcccctcagaaactctaccgcggatggagcagaagtcgtcgattgcgaaggtcccattcgagtgactactaggggagggcactggattggaagcatctaccccaaagactccccagcctccatcgttatcgccagaacttcctcaagatggccggttgtgtccgccactggtatcttctccatcggtctcttctatatcggaacctcctctagtggagtttttcccacaacttccaatggagaaatcatgggctcagcgatcaaaagaggatcttcatcgctcacgaccatgacagttattctagcagccagaaccctaacattgccacccgttgggactggagggccaatggatggaactttggcttgcttcttcctggccaatactagttcaagctttctcaagcgctctggattcatcttgtctctgagagttgcaacaaaaatcagaagcaaaaaagctttacaattgtcttctctgtacacccgaagggcaaacttaaaagaggacaaaggtgaagataaaaagctgctgctagaaaaattaaattcttgaaaaaattgtcaactatatggtcccatcagtcgtgatcattcccagcatactttcgcctatcaaactaacatcatcaactttaaatgctgagggcactatgaaagcgcaagagcgcgcatccctagatccaaggtatgattttttagatacttctttcatctgattcttaaactcaggagtagggaggtagtgttatggtagtaccgtggatacctcagatctgtgtgttatcaacgtttatttcagaccgtcgagctatcgctatggttaccgacctagcacagaactgagatatgcgaagccgagctatctacattatatccactgcgtagtctgttcaatatgtgagctgccaccgttacctcgacaaataagtctcctaacacatacagcagttgtccatcctaagtggataagctcggaggtaaccacctctcctaattttacgagagcgattaagagctaaaatatctcgtccgcaataacatatttaatagtcctacaattttgagattgcacgatttcacaactgttcgatcagctactcgataacattctatataaataaccaaagtttcgaagaccaaagtgagtaatccttctcagagaacccattattgttcttttattctttaatttctgatttgagcatcggaggatcctcactggagtaaaaatctccggctcgaacttgttttgttggtcgctccaatattcctgcacaagatttagttacccaccttctgacctccacaagaacaaacagcaacatgacgtaaatataatatttgaatgtcactcaatttcatcaagaaagagtattttaagataataaaaattgttaaagagataaaaacaaatattgtcctaccacattacctaaaaaattattatataatttaagatattgctacaactttagccctagggtcggggaattgggtcatggacctatataaatataatcatattattctactaacctttggcagttgttagatttttgtgattatcttgatgcacgatccttggaaatgttctcttgtagtcaacttgattaaagtatttgcttaaatcatcgtaaattcgaagccacattttttaaataattttggatgttcaaagaagcaatggattatgattattatttaaaaaattaatgtcatatattttctgaattagtgctatatgcttctttatttttttttacgtttttcaattttttaagcaaaaaggtatgtttcttttatcaaaaaaactttaaaaatttgtggccgctgggattcaagcccaggtctcctcggccacaacgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcacaatatattcacaaattatcacatcatcaaatcttgcaaccttccttcagacggtcatcaaccttttgccttcatgcatcaaaactttagaaaagacgttattctgaaataatccatggacattgtgatgtattctgatggaagtaataaatactttttctggtgatattatcggatatggaattttaacaaaatatgctatcccattttatttttaaattttcataatttcttcaaaaattattttgagttgcagacagtggttcaaagcttggaccgtggattcctaggcccacattctggggaatatggccaacagtataaccaggcctattccgaggcccatattctatggccatgagaaaaaattaaaaaaaaaaatttgttcaacgcgtgcggtgcgcgaatgcgtgcactatacgtggtgattggctcacgcacgtagctgagtagaaaaaaaaaatttttttttctacaccgttatctcattgtgtgagtcaacatcgcggatgatgtacaaaaaaatttctcaaaatcaaaagcatggacgcatccgtcccactttgtccagcagtctaacctaaacacacatctcgggactaaattaatcctatgaacattccaagctaataagaaacgggtgacggaacagtgcaactaaacgtcaattatctcctaatcccactttagctgaaagaagaataaacctaatcacccaccaaaacctgcaattgcgcctgaatccagaacacgaatgctcgtaaaattccaaaaagtgagatacccacgtcacgtcagtggccaagctagaaacttcaacttggcaatcgcaatacgagaggaagtggggataggtctgtcaacattgtgaaggaaacgcagcgaattccttttctcaagggaatttatatatttctatcagccatgctgtcaccttgtcctattattattatatattttatatggtcttcgtctgcgtgggaaagcacttgggtccgagtcgaaagtgaccgtagaagcacaaactgaaaagaaacggggcataaaataattcagtgcaccgcaagatgtgcttccttcactgcccccacttggaacgccaagtgtcatctgtcgtcctgcagattttggtttccttaaatgtgtataaataggagcacctgagcgattgattggaaccgaccagaggtggagtctttgggtggtagctttgtctgcactcgttcatattttcattcgattttgcctctctctctctctggtaattatgtgatgcctcactggtgtttgggctgaaaatgatttctgtttccttcctgggtcttctcttgatttttgatgagttttttctttttaaattttgtatggttttctttgtgtcgatgaattctatggaattgctcgtttgtttgctctcttgatgttttctatttagtttctctggaatactagtcactctgtgcgaacaatggttacattaggttatttaataataaactagcctttatacagattaatcggttgaatatctcgcttgtctccatcctctccattttgtccaaaaaaaaaaagaataattgtgttgttcagattctcagttcgaagttataatattaattttacatttccttcttctccttcttctttcagttcattctcacaatttccctgtcatgtatttggtcaaatgctcccctttcttaattagcagtttgtttacttgtttaccggttttcatccggtagaattccagtacaagtcacacagtgatgtcgagtatctctttttagctatgtttcttctttgaatggaatactttctgccattgttacagtgaattagccctgaggatctacttacttgtatgacctgaaatttccttccctatggacctcaatctaagaccacacatgaatgtggccttgttcatggatggagagagtattttcggtgtataactttggttgcatgttgttttgaataatgttttaaatcttgacgagaaggaaataaagaaaggaagggagaaaggttaaaaaaaaaaaggggaaaaaagaagaagaaaaaggtaggaaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaaatgcgagagaaaccgatggagaatatctctcagaactgctatcgagatggggtgggatagtggagcatctagttctgtggagaaacaacgacaccctatcccacaggttttaaaaccttgaatttcactttattctcgcgttcatgaagctaatcgttttcatgcgattcttgcaggattaaaattcttcgatggattgtgctggtactggagccaagtatgagtgcttgctcttcggtaagctaagacccgaggggttatactttgaaatttcaacaaagttcagcgagaagggaaaagaaaacgtatttgtggaaatttcccttcttctttgcaccacgatttattagttggaataagttctgtaatttcatggtgatttaatatcattgtttcttctcttttgaggggataactgaccgactctttgtttcatatccctagatatggatgataccttgtatcccttaagtttcggcctcaacttagcctgtcggaagaacatacaaggtgagctcaagaaaccttgtgattcacaggtttattatctgaatcgcttgtccagaggaccagaataagtcttgtttaaacaaagggactcattcatcaacaaatcatctattgctacttttgcgaaagaataaatgattagtctacagctagcaaggtatcatgtcaatatcaaagccactgaaccatgttaaaccacagattacatgctacaccatctccaaattgaagaaagccaagtccctaagatgtgcatggaattgtacaaggaatatggaacaacaatggccggtctaaaggtacaacttgttgcttgtcactgaacccttatttaagctagtttataatgcttcggatttctacccatggttcttgttgatattaaatatcttatttttgtttgttctgttctgcccttccttacaggcactgggattcaaatttgacaatgacgaattccattcatatgttcatggccggttgccatacgagatattgagacctgatcccatgttgaagaatctgcttctttcaataccccaacgaaaaatagtatgcaaatctgcaaatgaattctttgattttcaaggagtatttttttttaaaaaaaacataaaggaactatagatcatcttagaaaaggttggaatatgagaatctgtaattctgtatccccactagtggaatgattaaagtgtccaacaagcagcactgtttttacttatgatacacacactgcattaacatgtaaaaaaggagtattagatccttttggactaccatattaattactggttgatgcctttgtgcagatctttacaaatgctgacgaagcgcatgtcgagaaagttcttagtaagctgggtctagaagactgttttgaaggtgtaatatgcttcgaaactctcaatccacctcttaaacctaccgaccatcatgatgagaaggatattactgtgccttcaactgttattcagtctatgggtcaaaatggtgatggatgtttcagtgaaaccaattcagagactgatacaatttattgtgccgatccaagtaatgcgaattccaatatgccaattctctgcaaaccctctatggaagccatcaaagctgcaatcaagcttgcagatataaatcccaggaaaacagtaagtcgacttgaatttgagatcttgtgtttgattttgtgatgtatctgaacatattggaactaattgtttcctgctcttagatctttttcgatgacagcaccagaaacatcgcagcaggaaaggcagcaggccttcacactgtcattgtaagtggatgctttcctttataaactccaaggaggctgcaattcctgtttatgaaactcattgtaaaaatatttgtaaaaactactaaaagcttatctgttgtcgattctttcgctcggccaaacaattgtgaagttatcctcatataaccgacttgatcctaaaatctaatcaatgtttcacagacttttcaatttatttgcaacttattcaataagtagtatcaactagaaattaataattgtggctaaattgttggaagtgatctttgtttgtattttttttttttcctgcttttgccttgcatgtttattgcaagtaaatgtatccataaatcagtggtttattctctatttttttcattcttttgtaattttagttatccaattctttccccagaaaactttattctctgttttttgttcttttatagttctatattatctgtttctttctgaacttttgtcaacttgttatcattgttccaaatttctattcctcgcctctggcagtattgtatgggaatatcgaactttaggctattaccgaaattatacttttccctgaagaagtaagtagtagtactctatttgatctagaagcgacagtttttttttttttggaacgatacccactattttagacatgggcctcctctgagggcaagtattagaggatataattgacgcaagataatgatgtcgagtgtgcactaatgctcatctaccgataaacaccgcaagatgttcgatcctacaactccaggcctgctattgtattcagaaatatgttttcatggagtgcaggttgggagctcggtgctagttccaggagccgatcacgcactcaggagcatccacaacattaaagaagcattgcctgagatatgggagggtggagatgattccaaatcagttcttgcatccacaacagtcgagactatagttcttgcttgagcgtactctatatgttgccttttccccaatattgattgcatgtaacgttggagatttgtaagttgtatctagcatacatgaaagaaaatttaagtgaatggcaagttggatcgagaatgccaactggtgaggatgcatgattcaccatctatcaatttccttatctcttcatttttaacaaagtcctttttttttttcattccattttttggtcttttatgcttcatcaagcatgcactttgttgagactgaacttgtatggtagaaacttttttgaaaccctgagacctgagtaggccgagagagactcttggctacgaggactagacttgttagggtccgttcggttcggtatcacttttgttcaaaaaattgggaagaagaagaaggaggagaaaatttttatcaaaaaaaataataattttgagaagaaaaatgggctagattagaaaattcgttttccgtgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccctgaccgcttgtgctaccctctggccactcgcaccgtcccccaactgctgctccacgccgccggcaccgcaccccgacgctcgccccctccgtttgccaaaaaaaaggaatatgattataaatgtgtgcaggatatttttggaaaggcattctgagcggattagagacgttcttcggctgtgcacggtgaagtagtgcttctcgagcagtcagcggggaaggaagaaggaagaagaaaattttggggagaagatttagataggatagttatcgtattaaaagtgagggtatttttatctcacgaggaatttaaagttaaacatcaaattttaatggactgaaagttatattttggaccaataggacttaaatattaaagtccgatcacaaaatccccgatttcttatctatgtaacccaccaatggttaattgtgggtttttccttttcttatttgttcctttactcctttcacttcctacctcactttgtttttttattcttcccatattttactccgtaaatatcaggttattggataaattttgggtggctgtgtgcctctcttaaacctcaaaaaaaaaaaactactatatcattgccggttgaccttgaaaaagaaaagaaaaataaggaggggagaagaaaaagccggcctgttctctccgcttgtcaagagagaaattaataatacaaaatattagtacaacgtataaaaatagagcaaaaaatacaatacagaggcacaagggctctcagatcggtggggtttaatgagatcttcggggagggcttggttaattgaggtcaacacgatcagattttgggtcggacttgggtcttaattttcagcatccttgggggagtggaccgagtggtacagggcctacgcctcctagatattttcaaaaaaaccaaaatatttcagggaaaaaaatatctcaagtgagccgcgagtggagccgggaggagatgctgtgttcagcagtgactcaatcaccgtcctctttcccccgtcctccccatcccttctccttcaccgggaagcatctctcccatgccttcttcttcttctcctccaccaaccccaagaccgtcttcgctcgccccttcagactctcccttctttctaaatcctcatccgagccgatcggatccactcctccttcctcgccggaagacgcccttgaggatcccaagccggaacccgatctcgaatccgtctccgacgacgacggtggtgatggtagcttccagatcgagatcgagaagctggagaagaagaatgggcggagaatccgggccagaatccgggtggaggcggacctggagacggtgtggcgcgtcctcaccgactacgagggcctcgccgacttcatccccagcctgaccgtcagccagttgatcgagaagaaggacaaattcgtccggctctatcaggtaatcaatttcgtgtgctgaaaaaaaaaaaatcatttttctctaattttatgatacaaaatcgtgaactttacttgattttttcctgatagatatgccacaaagttacccaatattttatgaccaatttgaggaggccgactatgaagtcgtgaactttactcgatttctcttatatgcatgtgacaaacttatgaaatttataattcaatttgaggaatttcgtacacggtggcgtggaacttcatggcaattcgacaaaagtatgtgaacttcacttgatttctctgtgtatgtcataaagttacgaaagttaccatagttttacgaaatttagtaggtttcggacttagtaatttgacagaactgtgaggtcatgaactttgcttgatctctctatcgatatgccacgtggtttctgtttgcaaattacaatcataacaaagattctagtaggtttcggacttagcaatttgacaactttatatgtattaactcatggactttacttgatttctctgtagatgtgaaacaaaattatgaattttcattggaaggcattaggtttggtatggaatttcgggaaaatctatcaaagttttattcttgaagacatcaagtttactaatttctccgtggatatgttatagatttatgaactttaccatttcgtggaggaatgcagaagatttggaatggaatttcttagcaatttgaaatagaagttagaaaaattgctgaatgaaagtttttggaacaggttggtcagcaggacctggcacttggtttgaaattcaatgccaatggggtgctagattgctatgaaagagatcttgagatcttaccttttggtcggaagagggatattgaatttaaaatggtggaaggtgacttccatacctttgaaggaaaatggtccattgaacaggtctgcatctcttgccaattgtttcatttttctgggaactttattcttttgagatcatgccttttgttaggtgtttaagaacctttcactcagcaaactactaaaaccagtagaaagcaatgtgttgtaaagaggctcttttttttaaaaaaaaaaaaaaaaaatttcttttataacaacagaagagttgatagatcaaaaaggaaggtaataaaataagagatagagggtgaatagtagaataaaatctgtccctttttcaagggaaatctaggaggcctgcctcgttcatctcgatgtcataaaaagttcttcctaaaacatgagatattgagataggacatcgtgcttcttttttcttccctaaagtccgatggccctgcatcttcacattaggacctgagcaatacaaatttgtatagaagatagacaagtagattttgctgagaaatccttcaatagtcccttaatattttcatcatgtaatccaacttttgttttttttttgggctgtttgaacttagctgaagccccaagcagatcatacccaaaaaaccaacaacaacaacgagaataaaaagatattcacattacattcattgcttttgctcctagaggaagcattttgtctaagacctattgttacatctcctccaagagagatcatgtgacacgcacaagtagcataatgacatgcccaaatattacttgattttagagaataatcataatgtgctagccactgggacaaacttatgatcctccagttgggcataatctgcaatcaagttaaccatggtcattagcacttggtaatgaccaatttcttccactttgttagttcacaagtgtctcctttggtggccagatttaggaagtaccaatgattgaatttcatagcgaaaatctccatttgaagttatttcatgctaatatcatgctcttgtacttgtatcgacatcttgacacttctggccaatgcttcacttgcattttatgtcgtcagtatattctcaaatctcaaaccattttgcaatggccaaagccaatgttgcttaattatataatattattatactacaagtgctgttgactacagccaccatatatggattttataaaagaaatcaaccacaagattcacaatactgtggtttccttttaaattgaaaattatattatatttcaaagcctctttgacaaaacctccattttctcttgatagcttgtaatgatttgagttatttatatgaacaatgaatatctgttcaagcaaacttattatcccattttagctcttatttggaagattagccaatctattttatgtactggatattgggaaacaaagatatttttggtctattgataatctgcaaaaaataataacttcaagattttttttgtggcatgatatactaaattttacttaatagtagccaaatacaattaccatctcaactgtggccgagaggtgagtggcatggcagctgggtgtgaaaagaagaagaagagaggagcaaaataggaaggcagaaatcatgaattcataataagaacatgcatagaaaccaagttggttggtttactacaaatcccaaaacctaattgagtccaattgctatcggtatctggcttatccagcgccaattcaggcgagaacgagttgacatttgaccatcctcttttatctaaggttataaactatttatggtagatttcgtgaaacctgagggagtaccatctttctttgattttgtgtctctggaattattccctagcatcagcactggttctcatttatcactttgggctgtgtatctccagtatcatatattcttgtggaatatggcaagtatggctagtcgaaaataaaattctatttcaagctaaatgttgtgacacagaagaaaacaaaaatcagcagacaaaaagaaaattgcttgctgacatcattatgcagctaccacgccagtcagattttgtgtatttagtcaatgtaagatttatataatgctattggctttttcagtttttggatcctttaggtgtccgaggtttgcctgcacctttgattgttttaggtaaatgttactgtctccttcatcttaaccataggaaccttaagtaacaaaccggacatgcttatgactaggaaaacccaagctgcaggcaagaattctttggacactgttttagacataatcttctgtaattaccgtttagacataaattcctgctacgggataattatatatttttaacctaggctataaaataagctaaaatgttttttttttttgagggtaaaaataaaccaaaatgcaaacctggggtatatgcagattgatggtgatatgtgcaaagacgatgaaaatatggttgggaaaggattccagacaacactattatatttcgtagagttggagccaaagctttgggtgcctgtgcgcttactcgaagggcgtgtgtgcagagagatcaaaattaaccttcaaagtattcgagaagaagcccaaagagttcaagaagtgggacatgaggcgcttcctacctggtaaaagcagcaacattctccgtttgttttgtgtgttgttatgttctgcaaatctatctatgagaacttcatttgttgtttagcatttttagggtgcaaacatttcctggtaagcttatgattcctacatcaacgcatatagttcctcttgaactagtcagttgctatagactagatcccaatgttcaccccaccaaatgagcccatacagttgaagcttcctatgatcgttttgccgatcaagtcttctgtccttgaagtcttcacttgacggatatcagtgtcgtttcttgtaacaacgacttctacttaccacccacatgtattcttcaaatgcaagccatttttccagaccaaccaaggattctctttaactgttcacttcaagaaagccaggtcagatatccctggcctccctcatggccccaccttttttatcaactgttttagtttttaattccatggataagctgcctcttaccatgtggatgatgcagatgaaacttttgaggccatctttagactgtgcgtctgatggagtgtgttaattcagtgattgggtgggagatctggtcaaaattatagcctgaaatcacaagagctcaatactctggcatcatttactgcagaaaattaattagtggatgaacttttacttctaaaggaaaacttatttatttttcttcttttccatttgaaataaaagaaaagtagtctataccatttgcgatgcttgatgatgctttgaagttttgttttctcaaaccaggcatgacttcatgaaaattagtagtgtgcggtgagctctcatggtatggttcgtgtgtaggctgtagtgtcataaaagctctcgagagatggttttattataattggtcaaggaagctgggagaaacagagaatgctaccagtctgactagttgaaggagaagctgatcaaggacaaaggagcagttctaaagcagcacagggccgaacagaaagtcttgtgcttttgtggtgcaacaagctataaatttaaatgaagtcctatgatgacagaagcgtccaaactggtccttccaaagatcgatgtaggcaatggaaagatgagcacagcgatcctatcatatatataccttgcaaaaaataattatttacggctttcccctttctttttttgtgtatcatgaaaagtgattctttttcctactcttttccatctgtgaaccagtaatattttttcttgttgattgaataccgattgaaagttcagggatttgtggtcaagaacggcttgttgttaattgaaaaaaggccaccagcatctgtgattggtcggacaaattggtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgctgtgcttgtatccgattccaaaaccacctctttctgtgtgcttcttccgagatccatacttggagcaaagtttggcccatctccatagttctaacagaccttttatgaaactcaagagtttctatcctttaagcttgtttgtttttgttttttcttttctctttcttgagacatgtagtttgcgcgtgtgggaagaagaattacgatgatattgcattgtattgcctgccccccttgacaatttaagatgatagtcttgtccccttcatccttagtcccaactttattaaacttgagtgacaaatgaaacattcttaactgctcatgaatgggaaagtccaagctgcacgcatgaattgttttggcatgcatattagtaataatttggcataatttgctagtcccacaaatgccagacgcattatgaaattcctatggttttggaattaaagtacatgctaacttggagtctcaagattgacaacaatatgtgtgacgacatggagattttgtcggagtgaggattatcaactttctcctatgtcatagagttggagccaaagctttggtggtctatgcacctacttgaaggttgactttggatggaggtcatcagaatcagcattccaagtgtttgagaagatgctcaaagagtccagactaaagggggtagggcacttcttggtaacaagagcaacattctccatttggttgtgtgtatctttctagattaattgttgatggatgctttccaaagtcatagataatttctccacattggttgcctatataagtcaagtgtttgcgagcgacgcaaattggctttgtgcgtttgctttgcttttgggggggtgcttttgtgcgtaaaatttatctgctaattttatgattgttatttcaaatctgcagttcaacctgaaattttcattctatccaaaaaaaaaaaaaggaacttcatattgtcctcggacctgataatcccatgcagttgaagctttttatgatcatttgacataaaaagtcttctaccgcttgcataaaaattataatatatatatatattttgcctgcccacatggccccacctgtctggatatatgctgcaacttgccaggtggaagatataaatcaaatctatgaggctatctataggtgttcttcgctgattggtgggaagtgtggtcaaaaaaaataacctgaaatgaccatcgctcggtattgtggtatgcttcacttcaaaagtaactagtagatgaaacttatgaccttttacttttataaagggtagaattttattcgctatcttgtagaaaaaaaatgtagtccatatgcttgctgatcgtcccccctaaaaaagggggaaaaaaaaaggtagttttctcgaaccaagcatgatgacctcatgaaagttgacaagctgtgggatgggccttgctagtctttagcatcacaaaagcttctgagagatggactgcatcgagaatagagaaaatgatgccgacttcactggttaggaggagaagcacatcaaggtgtgaggtgaagtagaggccggtcgaaacctcaggaacaattccaaacagctcagcagtcagcactgaaaagaaaagattactgcatgctctgttgatgatgcaatgagccatcagttataaatggagaccttttgcgactgtagcataggtcactggttctttccagacacctacatagaggtgcttgtcaggacaacaacaacttggtgactgcaatcatattgaagtatatatctttgtgaaaactaaccctttacagataccaagtgtgattttggccaccccaaaaacaaaaaaaaaaaaaaggaaagaaagaaagaaaagcttttcttttgggtaacatgaagctggaaaagggtcaaagtatctcacgaatctcaaattattcaaagtttctcaacagcgggttgtacaatctataagagacgtccattacttaatcgatcgtccaaggtaaagtgagatgtaagcctatctttgttactaacatgtccggttttgggcctgctgaaggtaaagatgacacgggctaacttattgggtataataattattattatgtataaagtcttaagtggatgtcgtaacttccaattgacctcttctgagaaggccaataactagtgttagttgtgaatggtcccaactgccatgttttgccaccgcagtggaacaatattctttatttcttttctgtttattaacataaattgatgtggctggaaaggcaagtaggttcctggtatgctctctcttttatgaacttgagagttatacatacgatgagcaggtccgtcattacagcaatggtagattgggatattggatcttagcactcgaatccccgtttggggccagttccaagaaaattcagtggcagggacaagtacgtactctgactcaagcccatgtattaaattccccaaccgcaactgcgctgagttcataaaaagccctgtagttggggttcccacctaatccatccttcattaccgccacaatgcctctggaggatgaaactaatccctctggtccttcatttttgcgattcattctcttctttaagcatgtcatcagttattgtcatacttgttttctagttgagtaatgagccggacctcggggggcaagatttaattgtgggtgacatgacatggtccgatcctcacgacaaaggggaaggggtgcattcaaaagagtacgtaggtgccttgcgtccgacttggattcaattgaaaggagctcaaggcgtgaggggcttttttcctgttattattatttcagcacaaatcctcgatggtgtgtaggccgtactacagtcagtgatgactgccatcaatcaaaagatggacggccatcggacaatatgagccgtgtataacatggtacatgcttgttattttctgatggattggtgcaaggttgtgtggcctcgggcggttttgtaattaagcgtaaaccaaatatgttggacatatgtacggcgtttgagaatgtggtccgagggcaacattgttcatcttccccaaatttgtggggaaagttattttgtgtacatcacatttattgcaaaccgttctccatatattttgtatcattatatagaatccttgatcccatccatggtttgaaaataacaacggtcaataatggcgattataaccgtttgaaagccctcacctccataaatttcatatttgttatatagaatagaacgagcatctagagagatgaagcaggaggacgatcggatgcagctcatgaacggtcttgggaagtttgcaataaaaggaatggagattttctaattaattttctcacatcgcatatggtagaatagatctcagtgtcatgcattaacttattccctccgtgaaggaataattttttaaaggagtggttaagtaatttgaggatagaaatagaagtaataaaaaaatatacatagaagaggaaagggcactgtgcgcatagaagaagacgaagaagaaggagaaaatttacccgaggagcaatgaaaacaagtaaatttatatgtggtcaaaagtcttccaagtggatggcaagtcagcagtcccatgcaaaagcacgtgcatgtccttgctaacaccgcagcctcacgtgctgtaaatctaaattagcaacccgatggatggggcaggtaaaaagaaaaaggtccggagacagagagagtgagagatgggagggattctaaagaggtagacagagtctgatgtcacgctagtgacatccaaaggccaaagagcaaagcagagaaagctctcatggctgactcttcggtaaaacagtaaccgacaactacactaaactgttcttgtgacccaatttcagagaaaggattggattcttgtggagatgtttaacttctccaaccccatcactatcgatctaccccaccacaccgcgggcccgcagtataaagaaagtggccctaatattcattcatgtgatttaattaaccaagtggtcctatcaaaaaaaaaaaaagtaggcctaaaaagggtttgagaaatcaaattaggctttagaaacttggaggctctttttttaaaccgtatatgtttctggttccgggtcttgtttttcaaattagatactttgatggagctgttctttggggttgggtgactgaaacaacgacaagagtcctttttttttttttttggcacatagactcatatcacatgagactaagatttttgactattaattttctttccattcttcatgactttttttgggggaaaaaaaaaatttgacatctatagacaattatgttggtgttacacccgagtatcttgttctcgataatcaatgccaccgagtctctaaaaccctctgaaaagcgactactctaatacctgagcaggacaaacacatacggctataaacatcaagagtacttcaacaatgtcgattctcttctcctttctttccccgtccatggaatgaaaggtgatcttgagattatttgagctaatctccgccttgaggagcaaagaaaaaaaaaaaaaataaaataatatatatatatatatatatatatatatatatattttgacaatagtgtaaaaaagtttcatccatcaacataatgatatatttttttgataaaaaagttaaaaaaaattaattatagtaaaatgaaaatgtcaaattgataattttgaagagaacatgaaaatattttttttgaagtcaacttgataaacttaggtaacttttaccgagactctaaataattgtaggtacatattagtcatacaatgtcatttgtgcaaggaggtgccactaaaatctggcccaacctaattatgctgtaaggtgttttacttgatctgcaaggttatgggtctataaaaaatatcgcatcgagcttgaaatgataaagtggatccataaaaaaaaaagaaaggacgagcactaaagattgctggattttggcgagcaataaccactctcatgttatgcatgttataggacttaattgcatgaaacgtacactcatgagtcgagtaggaatagccatatgtcggatgagctttaattgcctttatacaagttttagtggaggcatatagcaaattttcattggttggtctaataagattagcaacagtgaaggtgcatcagaggttaaatatttatctacttcttgctcttttctctccaatacctttgtttcattcaatactgtattttttaaaaaaatatataaaatgagggtgaatagtggacaactgaaaaaataaccatgggatagaacaaaaatcacatggggcgggcactataaaagatcatatgggatggacttcataatgtaccatgtgtcccttaatactaatgtttaagtatgagtctaaaagttaaagactttttctattgataaagttattagttccataattaaagcattctctttcttcctcgttttcagcatatagcgatacatattatacgactatattgtacatacttaatatataaccaggtaatatatactatagatttttcgatatacatccagcaacaatctaatatacacttacagctaaattgatacatgatttactgaacttaatattcattagtacatagtatataactagttgatacacatttagtaaaatattcatccagcatttcaatatacacatctagataaatcgatacataatttttaaaatatagtatttatcagtacacagtatatgaacaaatgatacacactaaatagcttattgatacatatataaacttttttaatgcacatctagcaatgacctaatactcacctcgaggctttttcttctcttccaaatccttcttcttttctaaaatttttgtatgtaaaaatttaccaaaactatgtatcatttcacctagaggtgtatattgggacgtcggatgaatattttgctaggtgtgtattaactgatcatgtactatgtattagtgaatactaagttcgataaattatgtatcaatttatttgcaggtgtgtattagattgttattgagtttgcatcaaaaaaatctctaatatgtatcaacaagccatctggtgtatattattggttcatatactatgtattgataaatactgtattttaaaaattatgtatcgctttatctagaggtgtgtattgggatgttgagtgaatattttgctagatatgtatcaattagtcatatactgtatactggtgaatattaagttcagtaaaccatgtattaatttagctataggtgttattggatcgttattggatgtgtatcaaaaaagtttacattatgtatcacatggttatatattaaatgtgtatcatatgattatatagtatgtatcgctatgtgctgaaaataagaaaaaaaaagagaatactttaattatgaaactaataattttgtccgtagaaaaaatctttaatttttagatttatattttaagattagtattaagagatatatggtacattgtgaagctcacccatatgatcttgcctgccccatcccatatgatttttgttccatggtatgtggcaaggtgcaggaaatatgttgcttatgaatcgcggccatttattaacatttcttcccaggatgtaaacagatgtcctcagagagcttattgcctaaattttaggggagacagaacggttaagcgcaattcactacgaagaaacttggagcataaaccgaaacatggacagcacgagacgagacgagagaatatttccaacggtggggataatccaattccaggggtatcacgaaagaccaccaaattaataatgtcttagttttggactcggtcagtctggggcgggggatgccaacctccaaccactttttccaggtactattatatgattaatggtttgtccacacctccttggaaatttgcttcttggtaggaggaaatcatggtctccggtgttgaaaagaggactcggggggcgttcgtctttagattattaattagtcaaacccagagagagatcgatgggtttggtgcttgtggagtcggtctccagtggggccgcccacccccttggcttggcttggcttggatgctttcgtgccccgaggcttcacgtcatggtccccagccaaatctatccatataaaaatcatgtgctcatgcatgtatgattgcatgtacatacatgttcgcaatcatatacatgtcagcctgagccatgagatttttcattcattcgagatgaaaatagatggccatatacggattattgttattatttatttttaaattttgttttatgagatactaatattgtttccttttaagctcttcgtgaaagttagacttgatctagtgaccaatgaatgaggagcaatcatggaaatgttgcagaggcacgtgtcagagaccatccgcttaaaatttatccaaataatgataaatatttcaaagaaacttgaggaggaaaccagtgggccttcatccccttttccctctcatatcccggcgaccatcaggggctctaactcacccaccatcccatcatcaccttcgtcgcctctgtcatgccaccttggggtggcgaatagatggagtaccctctagacccaagggagggcagcctcgggatcaaattaaagatgactctattttgataatgcgtctgcggcagttcaatatatgatgaaataagtttggagtgctcaaaatggtgaaataattagttacgacgaggagatcttgggatacaatatatggggatttccttccttctttttttttttttttggccagagaaacagtacatagggatttcaagcgtttgcgtcgtgatcatgccaaaatttaaatatattaatcatgcagcactggcactaattcataaatagttcacaatccaggatgctagaaattgcaatcgaactattttaatttcgaacatttatttatatcggccaggatcaaatcttaaatagtcctgatataaaacgaagggacatgatctcatccaacatatgtttgaggctggagctttgcacatgtaatttgcacttgggatgcaggttaaccaaaagtgccaagtcagttatggaagtaacctcatcctttttgtatttcatgcacgtctcgacctcagggatattatcatatttatcatttgctatttcatgcaggtgaaaaaaaatacatgattgaatattttaactagaattctcgggatctccaacatttaaaactatacttaacaaataaaattttaaataatcttaaataccatgtggaaatgaagcggatgactttcacaacgaaatctgataatttcattggattttatattttaggcatttccaacctgcacgtttgacatgatgcataggttaattttgatctttgatttggatcggttgatatttattttttttgcgagcagtctccaatcccatatctttttgagctgcataaaacaaacatcaatatatatatatatatatatatattattttttatgttagatttcaaaattttaaatattataaaatgatctcttatataaaattatttgtggaattttgtctgaaatctttgagatggcaatgtggggttggattctttatgtagacggccattgcacacttgcatgattttaagaaaagatttatctacgtttgggcatcttaaaatatgaaggaaaaaaaaaaaaaaggaaagtccacccactccatccatttcatgggcgcgatcatgatggtgacgatgatgatgtgatgaccgagtgcattggggcagctattttgttattatatttatattgaaagatagtttttaatttgacccttaaatccaatcatgcaagaggaaaagaagaagacagaagaccgattgtaaattccccaaaccaaagcccccctcattcccactttcaactcccaatctccagacactctctcttttaccctcccaaaccatttgaaaactccgagaaagagacccctccctgacggggatgaagtgaactcactctcccctctcccttctcctcctcgcttccccccaaaacaaacacccacccatctatctctttcctctggatccaaacaaaaacccccatttcatccttcccatccccttctcaccttcctttctctcgtcccagctgcctcctttccttcaagatctccgcgaaggcgtcgcctttcctcccctttccctctccccggcctcccttcctcgccgttttctatcttcttctcgcaggattcgccagttgtgcgcctggatctgctgtttgaggtgcttgatccagggatccgtgggagcttcgccggcgcttcgagaggagggcacatgatggccgctcgttttgctatatctctaatatttttctatgttttcggatccaagattttgtttttctagcctgggattgatccttggtggggttttgatgccgtagctgccgagctgctgcttatgatgcgaacgcactggaaaagggctcatagggttgagggattcttcggggtttcgtggccaccgcagtccgagctgagctgctggcttatggtgaagggccagagaaggccccccttccagagatctctcggtagagcactcgccggtggccggatggttatttctcggtgttagggaagtaggtaatggggaacagtacttctcgggtcgttggttgcttcgtgccgctaggtaatggaaaagagggggtcaatttggagtttttagagccccttgatgaaggattgggccattccttctgttatgttaggcctatgattgttgattcccctgccataaccccgtcaaattctgaaaggtatactgtagattcgtgcatcctcgattcggagacgcatagcggctcctttaggcaggagatagtcgaggatttggctgccggggtgcagagggtcaacaagaacttctccgagactttctttaaaaccatatcgggggcttcggtcagcgcaaatgcctcgactgctcggaccggcaatccaaagatgctgctctcaggcgatgcccaggagccggctgcttcgttcgagagcacggcgtcctttgctgcgatccctctccagccggtgccgcgcgggtctgggccattgaatggcttcatgtcgggacccttggagaggggatttgcttcagggcctctggagagaggggcgggtttcatgtcaggtcctttggacaaggctgctttcatgtccggtcctcttgacagtgctgataggagtaacttctcagctccacttgcttatggccggaggaggccgggatttggacggctcatgagaagcatgagtcggcccatgaagagcgcactctcaaagactttcacgaggcgctctcagggtcatcctggatggatgcagcggttcctcttgcatccgatgacgcagctggtgtggcattccaaggaggcaaagtttcgaccggaagctccacggagttgtgtggaggttgggccatccgaacccgagtacagcaatacacgtaatttgcagtgggctcatggcaaggccggagaggacagggtgcacgttgtgctgtctgaagagcaagggtggctatttgttgggatatatgatggtttcagcggccccgatgcacctgatttcttgatgagcaatctgtataaatctatagataaagagttggagggattgctatgggattatgaagacaagcctggaaaaagtgtaccttcatctggtcttattgaaaatgatggggttggggtttcttcggagtttgtaaaggaagaatgtgtaggttctcagttgcagcatgatgatttggaaaagcaaggtgaaaatccttctcaagcacatgatggatgctccaaaaagcagtgcaatgacggagttgtacctatccagtcaaacgaggatgcaactggtttggaaactacagtgaagaatgggtcaggtgaagcattcatggaagctgatgaaatagtagaggaaaaggatggatataaggacaatggctggctgcaaagtgaagctggccaagagtgtagcgcaaacatgggtgacagaaattcagaaacagcaagccatgtcaatgcaccggagagtgaagcctcctgcgttgcagcaaccaaattggcaagccaatgcagaaaaagcaagcgcctttatgagctgcttcagatggaactgctggaagattatggttccaacgagccatggttgggatcagaaatttggaagaagaggagttcctgggatttgcagtcaagtgccagtgaagacttgagtaccagagaaagcttaccaatggcacagcctgtttcttgctcttcaagtatcaaaggagaaagttcaggtcatgtggaagatgctggcagtccaagggaaagcgagggtgttttggggaaagattccagagattcaaagcacagatccgttgcttcattttctgctctgggacagaggcagatgatgaggagatcattgattgggtcaaaattgaggaaaatgtacagaaagcagaagtcattgcgtaagaaacttttcccctggagttatgattggcacagagatcagccccatgctgatgagagggtagttaacccgtcagtagtcgttaggagatgcaaattagggccagtggatcatgatgcagtgttgaaggcaatgtcacgggctcttgaagcaacagaggaagcttacatggaaatggtggaaaaggcgcttgataaaaatccagagcttgcactgatgggctcatgtgttcttgtgatgttgatgaaggatcaggatgtttatgtcatgaacctcggtgacagtcgtgtcatcttggcacaagacaggctaaatgatcgccatgctaaccaaaatcttgcaaaagatgatatgaggcaccgaaatcggtcaagggagtcacttgttcgtgtggagttagacaggatctcagaggagtctcctatgcataaccccaacagccgtgtctgcaacattaacaagaacagggaactctctctttgcagattaaagatgagggctgttcagctgtctactgaccacagtaccagcatcgaggaggtaactgataaatagttatgagttttatttgctttttccattagaagttcactctacctagttctcaatcaatctattacatagaacctggttaggatctgtgttgcaaatgccttaacgtatgtgcaaaatcacttgatatctttctgaaaatgcttatattttctaatcagtaagtgattgagaatatatcaaaatgctacatttgtttatattgttacataaactattgcaagcttgtttatggttgtagagaatccatgaagtttttgatcatggtgaattttcttcctgttttaatagattatggacatctgtatcatcatatttatagtacatgatattgttcatgataattattagcattgagtaatcttctatatctagcaattcttcacaccctgcctcccatttcctgcttaggtcaaaccgtataaataaatacttagccagtggtgctgaacttgtgcttctaattcattcttttgctgccagaaagcaatatttgaattaattctattaattctgtagttcttactggactcaataaactttcccagagagggaaaggtgatatattgaagaatttgtgttgtttcttctcaactccaggacctcttatcctctgactcttgtggatgtatttataccagagttgtatagtatatccgccctaacaaagaaaaggaaaaaaaggaaaaaagccgagtagatatacgtcttcttcattcaatctgctgtcatcccatatgcaggttttgtattgattttgatggtggttatatacactcatgaacaaaaatacgcacagttatcctgccattgtattgcaacataattttacttgtattttgctttttaaatcattattatgtatcacattcataaacaccatcacaacattgggttcattggaagttttcccaaacccctaggtactagagatagcaaaatgcgaactttaaattcaaactctttaattatctaaagccactcaaaggcttggagcttttcttttgagaaatcccttgttaatgttagttctgttttttggggaaatgctacaatgcatttattgttccatacacatatgagatgctctccattccttagctaacagacattctcgatcaaagaaaactctaaccagttggtaactgtttttgatgaaaggacaggtcaaaattgtgccttgttataaatatgaacaaaattagttctaataatgtagctcttggtctttttctcatctggtaggaggaagatatcttctttcaatctctggcccatctccttcgatgcccatcacaatgctgacttcttctctccactactcgtgtgtccctgctaaactgctgccatgttttctcccttcccccttcctttgcctccctctctagttgtcaaggaatttacgacaccaccaccaccactaccttgccactttggtgatcaaccaacctccactgcgatgccccctctccactgctccagcgcctgcagttcctcttccaatgctctgtctgatgatttggatcattgtcattacttagcgacactaattattcactgcctcaagccacccttttttctgtgctgccgctattgcgtcttttcaccaacattaccttgtcattcatactgtgtttacaggaccatgagcctggtccatttaatgcttcaccaccagatgtccaccaccgaagtggacacccacttatccactctggaaacttcaatgcaactggacgagccaaataatatagaggatgacaattctatccctatctgaaaatggaaattgcaaagcactatggctaaaaatatttaaaagtaccatagcaaaacccattgtcttgatcaccttcttttgtaacagccattactcatgatcctttttatttgagccaagtcttatgtccttgttctaattgagtcatgatgctggattgaataaagcttagcaatcttatatggtggttttactaaggactgaacatttctatagttacctatttttgagaaaaggtttatatatttagttattctctttccctttatattgacaaggtctaccaagctaaggtgtttgaccaagaaacaatctaacaatccaaaaaatatgtttaattcaatttaaatttaaggactttcactttgtagccataattgttcatgactatgaatcaatgtcctaactgtgtgggttagcttaatgagtatttacttattttaattgcacctgttgttaaatatggttgtttaaggcttgccttaccccacttcttgagccgaggctcaccagggagaccataaggctcatgcctggggctttggaaggattgctactcatgttacatagaagtcttgtctattttctttttgtgggaggcaggtccactaggctatgtatttcatatttgcttggagtattatatgcagtatggtggtaatgattcaaattaggtgacacttggtaaccttcttttgagacttgtgcacaatttacaaagtatacaacttgaaatctttaccaaagttcaaaaataccccaggttcaaacacaataatcatatccttaaccatgtcgtgtcagtggttctcttgtttcaagtattccttcatttaagaacgaggatccatggttcttacaccttatcctcgaggcttacatgcatcaagagtctaggggccttaccatacaacgcttgtttaaaacatggttaaacctacacctgtcaacaggtcaggttccgacccaaacctagcctaattaggttagttaaggtaagaattttgatccaattacttgattccacttgacaatgatcgtatggaagctggaatatagatatacatgtgactatgagtatagatatccatttattacaataattgataaattttatatacagccacaggatgaccagttattcattcattttgatgatttatccatccgaagctctttatatatctacttgttattgccttggcaaggtgggggcttacatatcatcaaagtctccttggtttattgaagatgtaacacttggaagggagaacttgtggcatatctctagatgcttgcttttttggctacaacttgactctaccgagtcttagaaccatgccattaccccctttcttgttacttaatggaaactcaaatttgacgtaccttaagtaacagtgaacaaggtttcagtgatgccattattcctgtatagtggatccttgacaaaactattattgagcaattaaacatttatcaaggctgttacttgatcttatctcgtgtgatttggggttaatattaaaatgttaactgtataatggccaccataatggcatcatataggaaaataatggagaaataatgttgttatttttgaaattattgtttactcacgaaaatatttttttgatgtacaaacttttttaagggaaaacttttgaaaatttgaactttgaaaaatattgttttattaagaaaacaatgtgaatgtcaaataacaactcttatttgtggtataatgggctgttgcaacagtacataaccttttacaattgctgttaactttccccattatacatatagttggacttggctatactcaagtggatctccatacagatccagttagttctatattggacaatgagggtcttacatctatgatccgagccattggatgtgctctactacttctaaagtgcttacataccaaaaatcatgtgattcagagacccctagcctatgcatcaagtgataaaaaaaaataaataatttagcattatttagactgtccatttttggacaaaatagggagataatgcagtgccctttaagagtgaagaagcgtaaaatttgggattatatcaagagaacataagagcaaggcatcaaggggtgaagatgttttgatgaaaaatcaatgtggcatcatttccatcacatccaatcaaggtttaagacatattttcatgttatataattagatggtgtattgcatattagtgtatttcatctttaattagtagtttaaaatttgtgtaagagagcaaaggaacttcttattctttcattttctttagttgcatgtgttgtctacaggaaaaggtatctttgttaaatacatatgcgccttttcttccttgatttttttttttggtaattcttgtggatctttgactgattaccacaagactactctggtcttttttatataataaaacaaacttctgactgaaattttggttgtcaccggccctcttgagttcattatcaaataagtgtgctttttaactaaatgcacctgccttaagttagctatccttctcttctctctatttaagagagagaagagtgaaaaactaccaataaaaagtaggaagctgatcaaaacctatcataatgaagttcataatatactttttatgtgcatctcacttttttattgttcgttgatctttttttgctaaggaatttggaattgatttgtagaacttcaaaatgagctacttgaacagtggcgaagcatttgaacttctagagaaacatgccctttaagagagacatttttgtcaactatttatgttggttttccttctgattaccctataaatagtataaaatatgaaaagtcccgtgagatgcatgccagttggtagcatgagtgtgcttgaagggtctgtatgcaatctgaatgggccttccattgatcaagaagtttccataaaatatttcaccatcagtgaatatcctattgatgcagaagaaaaccaaaaaaaaaagtaaagaaaagaaaatggaaactttgtctgtaaaaggcgacaaggcaaaatataaaagatgatttggcagattactttgccaatcaaagtttgccgtctctgtactgggccctgtactggtgccaatctattactgtgtcagtacgaagccggttcggcctatcgaatgtcagtacgcccccagactgcatactagtactgaattggtatggtacggtatgctctgtaccattcagtttagtatgcaataccttgcttccaatgttggtggacacatccacccaaaagtgacaaaccactggactctccaaagctctccaaacttcatagacatggtaaagcctccctgttctcttaccttacaatggtatatataagtatcatcataacgttggaataataaggccaaccaccatccaacttgattaattgttttcatagtaactacttatcatggaacttaaagagcatcttacaagttcaacacaatccaattcgagctgtttcttgataacatttcaaattagagaaatcttcattatatcttcttttttctaggtgtatgataaaactttcgctactattattaatacggacagtgatgcatgacaatcatgatgtcataagcttcatgtgcatcaggatgtaccggtaataatttgcctctatcacctgccaaaatgatagggaatttaatcatcaagggaaaaaataactcctcactacgagaatatggataatatgttacttagacaagacaaacatgctgatggtaaagtttcttgttgaatcctgtaggacttgcaatagtagctacggaatattcaatgtatatagagcatgctgaataagtagggtgttcactactgcaagtgatgatatcgggagagattgagagaaccaaactctctcatacatgttatgtccgttgtttttgagctaatatcaataactgaatgctattttccaactagtgatctaggttgagcagaggaagatgcaactaaaattgcatctattttttccctggagcatttagaatctccattcattaattacacctacttgaatagtggttccctttgagacaatcttcagtagtttgctatcatcgtacttcactagtctacatcctattgtagatgttgcccctcgatcatttgctacaagcttgttgaatgagggaaaaaataattgaattgtccacaactacaatatcttgtactctgctgataacagaaggaaataaggaggaaggtaatgaagaaacaagttttaatgtatgttttggagcaataaaacaatgctcaagaagcttcttggagttatcttgcaaagagtttgtccaactgtaactcctatggattctacttgaaatgaagaagaggacatttaatatactatgttttttcataaaggttattgcacaaggacgcctagtatataaagcatgtactggaagtagctgcagaaacttttagtctttacaaataatgtgtgaccctgaagatgaatatgatatcagatgccatgtgtcttggttcaaaaaggtaataagtgtgaaatgtaaaagttgttgttttgcttctccattatttttaaaagatacacattataagtttatgttgttgtgttgtacttttgcattagttggataggctttgtctctatgggtgagtacaccatgcatgctggcactataagcaccttcactcttagaaagagttaactcttatgaatgcctttggagtaatttcatccaaacctgcacctattctaatatgtagtaccaactttcccaatatgtctgttggtgaggcatttccatctgtccatgtttttctcccctgcatctccaatttgcatttcccatactgtatctgtgtctttttcaagaccataaaggcaacccagatagttgggaaaaggctagatggttatggttatgagcttgcagtttactttatttttgaaagaatgtgtgcatcgcatgtgccatggtccagtaaaaagtaatttgatgattgccaaaccttagacacaaaagggcatcaccctgaaaataactgtttaagatctaaagagtacatggatctctttttctccctcctccccactgtacataaaaatatgtgaacattgcataaatggcttcatgagccaaatgcacctatttacctagaagctcttcattctttatcatatatagtctgttaattactacttctagaagcagcttaatgcttgactgtataccctggttatgtctcatcgtttatgcaaattctgcaggaagttctgagaattaaagcagaacatgctgatgatcctcaagctgtgttaaatgatagagtaaaagggcagttgaaagttactagagcatttggtgcagggtttctgaagaaggttagcagaaacactatgcttttaaatagggtccacatgcatttctttttttttttccctttttttttgtttgatacatatagaccaatatttttaatttatttatttgtttatgaggcacattatcagttggccctgagctgaagatacagtgcaacaagttgcatggttttgcgatatgtttcttatattttgttttccatttattttatgaaaaattgacatgaacatatcagaaaattcaacttatgaaagctcttcaaaacatactagttataactgtaaatttattttcttgtgctcattttctgataaatttgatctcagagtctaacatttaaacctttgagttgattttttaggaatgtacaaaaccaaaaatatgaaagtgagaaatatgggttgcactgcatagctaaattctagaacccctctgcttgagcagccctataatctgccaatcaattttcttttcatattttattctgctcctttctattggcttttgcatggtttttgtgaattttgatctcccactaccattcattttcaaaataaggattaagtaaatcataaactcttttctagaatataataaggcttcaaatcttagacttggacttattcactttatgtattaattattaaaatttgagtatctcagaaactggtaaagttttacaaagttcattattctatctgcaatgccataataaaattttgaattggaatgactgtaattgccttgctgttcttgttgggctgcagttcaacaattgcaaagctttggcctgtccttctgccgactatggctttccaatctaattgtgctctagctaaatgacaaaagaaaagggaaaaaaactggcctctctttcactctcagagggaagggggcatatttacacaaaaactcctaggaccacttcattttttattccaagatccacttcttcccatctggacgacttgttagtggctcaataatctcaaagagaggcctcagtagcaaacaaggtggtcttgttttttcagagaaaaatgctcagaatgtgatcacagatatggcttaagcaagccatgcatctgaaagagagttgttctaaggaatgggggttttattaaagtaacttataatagaccactgtttccaacattggattgtgaagtggactagaattgttcttccaagaaatgacaagctcttctatgtcatgccaaccacatcgaaaaactatgcactaggaaaattttgcgatgtcagaaatacttccttttaggtatcaatatgagatattttgtcatggcgtgttcctgcccagaaacaatggtagcatgcttgtttgttcaactattgttgataatgaattagtggacatgctgattctcttattgaagtactaaaggcgtacatggccatcactctattacgttggtgatatgatggcaaaggcaatagaacaaacacttagtattgtatggagaatgcttaagccatgcaaactctaaattaaaggactctatggagcatgaatatgtcaaactgcacactatgtctatgttggatatttattggatactgatagttgtcagatgcttcatagaaaggatttgactggtcgactctataacactatataactaacagacagggggcattatacacacttatgcactcctgattcaccctctgtgaatgcccacatggactttgctgtaggctatgttacctgaagcagtctgtaggttttctgtgtgggctcactgcattgctgcaggaagacatgatccaatgtatgggtctttatactttacaaaaatggttgattgaaatgccatagcttggagaatcagtagaatttctgaatttgtgaatagagtggaggacgtttgatactgagtagaatatttctattgcccaccatttatggtcgtattagtgggcctgtcaagtgatcacttgtagatttggaaacttgtgaaaaggccttattactgagcagccaggaaaattacgtttgcaagctgattttgttacaacttgtgtgatcattgtactcagtaaagttctttggggttatgaatggaattatggaaaggattggtccgatattcaggataatttaattcaataccaaatcgaaaacattagaatgatgatattaaattgtatccagaaaagaagcatgcataatttgaaataactaaatttgagaaaagcaatgcaatgcaccaatcagcagctttttatctccaaatgacaaaacattttaaagaatgagatgttaaaatttgtttgcctatcaaagattatgttttagagattgatatctttgatagaagaatgttggattgtccctaagaggcacaaattagaaccagcaatgcttatgaggttgagcttttataaggctttgacaaatctagtcctcaatgtccagaggtggttaagtagaagctttttctcatgttgggttttgggaagcaaattcatctccacaatgaaatgctattgggggcttttttttttttttttaatgaataggtgattggttcccaatttaatgcttagtgaaggaagatcttatattctactgaagctgcatggttcatgaaggaagttagaatattgattacaaagttgttgcccattgcagatcatgtaacaatttacttgagcatgagttctttctaattctgtgtgtttaatttgagctaagcctgccaaaatgttgttttaggacctataggtgtgtggaatggatcgagactaatttaggataattggactgtttactggtttgtttcaaaactgatttgatgttataataagtggactatggtctatggagtaggcttgaaattctgagcatttatgaggggtgttaatgtcctctgctagggaacattcagcgagttgtgatctcttctagtgggagtccaaattgcattttaaatcatcaaaacaaagcttttctagatgataagctgagcagggcatgcttttatccggcttgtttgttaagtatgagtcttaaaatagactccagttcaagaaattagtacatataagagactcaaacgcagcatttctcaatatataggaaaaaggtgcttactttgtcatgtaacctatccttgtatattcttaatgaaaaacagctcacatcttcgtatcttgtttgtgtgcatttgttataatctctttgttctcatcgtctgctatagttttggtcagatatcatgttagaaactttggatgtgattttctatttaattttgagttaacacttggaacatatcctcaattcctgaggaatgatacaaatctataatcttcacgggaaacaaaaattaaaagagaaggaaagcaaaagaaactgaatagcaaaatcaggaatgagtagaccaaaagggagaaatagaaaatcactgattgtttatgtgcaatttcttaaaattctataggtgtctggagtattctgatgaagtttcgcatgtcagattatttttctgataggtaatgttgggaatccaagattgtctcatgatgcattggaaggcggcaggacttaagattcttctcagactgatttgaatttacttgtcaaattgttgttttccttcttattacttcagtttttagtgggtttattgggaaacaaaggcagaggttaaaaatctcagattttgttagatagtttattgggggtagcaatgtcattcatggcatttctcactacagttactgtgaacaagtaacaatgccttatgggggatatttttgggattacaaacaaattgttagggtttctatgcttataaactcagctcttagagttatgtaatcagatttatatggaagaagaaaaggtgaatgaaaaattcggtgtccttttctgtcctgtggtgtgagccttagaagaagcaggatgcttgcaacccaacttgtgattcttaggtcacacagagagactgatattatccctctctgctctttacttctctgtttattctacagttgggtatcttctgctcttctttctctctttcttaccttaccttttggtttcactccactagctttgaaaaaagaatcctggcatctttatttcctgctctaccatttccgtttatcaacaagccccccttgcagcaatctgctgatactaggaccagcaaacagtcctttaaaatctggtcatagatgagatccaatcagtcctgctacaatatccagtgatgtgatgtttaatcaccgaattgcttctgcttgataccaagaccaattaatcctaactccagttggatgcttgatctgcacaagaaaaaaaaaactattgttttcgctgatgtgtgatgtaacagttattcttctgaattttctactgcttgttcactttctagaacatgcctcttccctattaatgctcagcaacatttatcgttttcttccttccaaaatccctagttagtacttatgtctaggctgtcctactggtatcatagcaaagaactctaggaatttgagcagtatggtggtgcattttgctggtgagtggtgaaatagaatactattgtatgttctgcatttactattagtcactaatagagaaaaactagaaacgtgacatttcattagttatgagcaggatcaaagatgccaaaagaaatgtacgtcctaaaccttgaatactggaatatggtggattactgatccagaaggccctagtacttgatttataaaatcttatgtgattaataaaaattgtttgaaaaaaagattttaatgcaaaggttttattccttcttttgtatgtatatggaggatgatttaccaatgtcttagatgtccagggtttataaaactgaagattctaagaaagatgtagatttggttaccatataattgttggatgtttgaaacttaaatctactcatagattctagtattatgttgccaaaagtatggcaggtattaaagttagaagcaaatggtaggtgctgaagaaaggagagtcgatgctagatcttgaactcttgacaatggataataggtaatagagacaaatggaacaaaaagaattgaagacggcagagggaagagttcctaaatcttaagatattaaaccttttgaactatttacttatgactagtggtgttcagacaacagcagtgtcctcctaggtaactgcttgggtattgtgttgcaaagaatgattggcaaatttgggcatgattttcccacctgacatgaccggtttaaagttggttaggcatgtttgtttgttgatcttgtacaagttaggcatgaatgtttcacctactaacttgtttgagttttaataatgaggaagaaataaattacattacaaaatgtaacttttcttcttcccttaaccaagtaattcatatgattgactctcagattttcttttcttagtaatgagatttaccaagggcatgagcattttggaatatgagactacaaaattacgtacctcatcacacagcaagcttgtgacctatggacaacaacctaaacaagagtatccgaatgttattatctgatcattgtctttttattgttttggagtttaatttcaattttttgtcaagttctttcagtttggtgaacaacactatgtatattgatcaatgatgtcaaagacgtctaaaggtgcatctcaagcgctcaggtgaggcgtcagaaggggtcattgcctcttgatgcttcaggcgatgccccttcactcaggcgcacgcctttgatgccttatagggcctttcttagtgagacgaggcgcttgcctctggcgtctcagtgaactctataattattttttttaatggttgaaaagtgtaaaaaaaatctaaaaggccattcatttaactttttagctctattactaataagggataaagtggtcaattaagatggcaaagttagtcttaaagagatagaggctgattcagatgagacaaaagaagatgttgaaggatataaatccaatgaaggaggagaaaatgaaagtaatgacaactatgcaagtggaattgaatttgatgattccattgatgaactttaggtgttaggactgtttatcttttttgtttcatttatatgattctactttagagctgtttatattttttattttatttataagattccattgatgaattttagagcttgttatgttttctgtttcattcatgaatttagagctgcctatggcatattatcatatactttatcttgaactagttgagtattttactgttttatatatgtttcatgcttaaattgttaattatatggtaattcatattacaatagttatctttagttgttatttatttatatatcatattttctatttttttcttcaattttaacactttacttcattcgtacggatgcttttctagtgcctctcgcctcaaggtgctagattccccaagcgccttaagggtgtctttcgcctttgactaccttgatattgattgcttagaccttgtgtggcctttagttgaccttatcttgacatctagctttgtcattcaaccccttgtgctacatgaagataaactgcaatttgcaaatctattcttttaagtcataaggggttaatatacctgacttgtttgtgttttggtttggaaaactgctcacatttggtttatcgttttaaaatacataatttattaacttcggctaatgttggtgggtttctaatttttctagatgtagattgtactaaatttgtaatgagggcagtcaccttgaatctaattcagtaggatagtccaaataagttttcagattgggcatattgttggaattgtttatgtactgacattctgtgactggttttctgataatgaacattacaaatcctcatgcaaatgttgaattgtcgaaacgaacccatgcagaaagaaaggaaagatggagttgcacattgactatgtccaagatccacgtctatgtctatgcaaatggcacagtgtagagcaagcttgatatggtcattaaaactttctccctaaatcccatatttatgatggaacttgaatttttttcttgggatactgaatagatcaaataaagtattcctgtttgtccccccccccccccccccccacacaattttttcttttcaaaacactgattgaatgtcatgaaaagaaagtgtaaagcagtgttgattaatgaaggacatcggtcttatattaaaagtggtcttgcatgatttgttgatccatctggaaataaatgtgacaatggtttttgcagtgttgtctatcttcattgctaatggactatgagcagtcgttgatgtgcatgatgatgatcattgggattgactttgctatccacactcttaatttataatttggccatagttacaattaaaggcttaagagttttaactgttcatttattgtgtcatgtgattaaagtgtgccctatgagattaaagtaactctttttctcaaaactgccatgtgaaagaggagttgcagttctttgaatttgttatggcgctggtgtatcgacctcggtctctgcaaggttgctagaaattgctctttctggtggttcttgcttttagagcaatgagctatattcaaggttttaggccaagtaggggattgaaggtgaagctctcatcttatcttatataatgtgcattcttgaagggccatgctcttaatttgctgtcatatccattatgtaagatgaatttttttcctgaaatttctaagagttgaatactcttgaactaagatggatgctttaatatgtgtttctcctaaaagaaaatgttgaaaatgtagaaataggttgtgtttaaaattctagtgttttaatcctgtgttacaggcaaaggacttgataaccatgttacccttattttaagttttcctttagttttgctagattgatgaaaagttgtttttgtgggactgattgtgctggtcttttccttctgatatagccaaagttcaatgaagctttgctggagatgtttcggattgactacgttggaacctcaccatatgttagctgcattccctcagttcttcatcaccgtctctgctcaaatgatcgcttcttagtcctttcatctgatgggctttaccaatatttcagcaatgaagaggtggttgcacatgtgtcgtggtttatggaaaatgtaccagagggagaccctgcacaatacctgatagctgagctgctttttcgtgcagctaagaagaatggttagtggatttgacatcatatgtttttttttaatcattaaaaatctttcaattctagaccactttttgattgattgtggaggtgtcagtttttcgtaaaggtaatcatgtgatttctgattctcactgaatatcatttttctcccttaaagtgcagtcaccgagatgcaagtgtgatcaattcctccacaatatcttagcattgatcgagttattttttgagcatcctggcaactcagaccaaaaccaaaaccctcaaactttatcccagtgagattcatcaatattcatccggacaaacatctacatcctccatcaccatcaatttttaagtctctgtcaaagtcttcgtctaagttaccttaggtatcgtttccaatttattttcacagctcacttgtctaaataacccatcattgcaaatgcgtgacaccctcattgttgaagctttgcctgatttttgttgcacgtcatgtttactcaggatacagacagttaccaataagttcttttgccattgatagtttacagtctagcagtctttaaattgcaaatgcattttttcacgtacatgcaacatcttgcatcatgttatggaaacatccagccatgaacagttattctgatttcatgcaataacgattgtgaagcttttgggtccctaataccgtaatgattggaatgcatgtttggttttcatattctctctgcaggaatggactttcatgaattgctggatattccacatggtgatcgccggaagtatcatgatgatgtttctgtgatggtgatttcccttgagggaaggatttggagatcgtcaggttgatcactgcactttgtgaatttgtgtccatccactcatgtatcaaatttacatcaaggaaggccttttgtttccttcatgagctctctcttccttcccccgcaccacccaccaccacttccttccccctccccccctgcttactcttttccttcaggtgagctccgagttacaaacatttgtgctggccatcgctatttacctctctgtgcatgtgctgtcatccaattcattggccactttaaggattaccatggtcttttcagtcatttgatcaatttaattcatggatatcaagagtctatccactggatggctgtgatgcaatgaattaagccatgctgggcatttgcatcaatgaaagatctgaattgaaaagaaagtccccaagtaacctgttttctttcttcatttttgtttttatttttatatttttctatgatggtgccatggacaatttattgatattgtgaaatcattatactgaaacagagtggccatctgcccaaccgttctcgaatatcaagttggtaaatatacaatttttgatggaccaaacggtaatgcgtttatcccatttttagccattttatttttggactgttgcaaaaggtaagataaacaagaaagggcatgtccgtttaacatatttaggttgttggcgattaacattcacatggattgcaggtaaaaccttatgagggtattgcattggttagccaattctcctatggctaaattccagatattgctgaattgtgcttggatcaggctgaaaaaaattgatagaactcaagggaacattggtatggttgttgaacaagtagtagatgaagcacctaggttaattttcaatatgtgagtagctatttgatgccgtatctagataagttctttagggcgacgctgttaggctgcctttggtttgggtttacaagaaaggttaagtaaactcaaggcacctttacaatcatttgtaacgtgtcaagcattaacgatgtgactctaagggcaaagtgaaacttgtaaaatgatgtcaattttagtttttccacctaaccctgagatatctatttcactccgtagggtgtagtttatgctgtagtggattagatgcaacttaatccatttagttggaagatggcatgttttgaaaccaaatggtgactaattgggattaatctatttatctaggcttagtcatacaatagcattatcaagattggttgtctcgatgtccagtcttatattggtatcatattggtattggtattgcttggtttggagtcggtaaattgtacaggcacttggtatctccttcgtctcagttcgataccagtacggtctgatatgttcagatggtgtgcgtcaatatgggaaactatgagcatgaacctcataagaatatcttacccgttattttttattccatctgcatagggcttattttatctgcataaggccatggggaaaaggatctacaagcattgtacaaataaatcgaaagaagttgatgattttgaagaacaaatcaaatattatgatgacattagtacagcatcaattgctatgtattctgggtgacaaaggtcaaactctaaggctgcatttggaagcagaatacgagggagtaacagtgatttaactctgttattttatctttttctaaacaaacatttaatggagcaattagattacatcactttcaaaaggtaaaataggtatttccaaaaactacaaaatttttccttctaatccattcacctcactatatccaagaataagtgaaagcttgaatttcttggtaaagaattattctcccccttggtcttggaccagtctatttagttgcttattctcctactgcggcagcattagaggggaagagacagaagatgctgatggtttgcaggttgtccagggatgcactggggaggtcgagaagtcgcccccttcatttttcattgggttttagacttggtcttatctcagttgcttttgatttttggaagattctgagttgtaatctttaagacatgctaaaaccctgtgtacaatggggggttggcttagttttgcggcttgttttgaactatggtgtttgatggacttgagctacagctgggtgtgcaggaatgctggcttcttcttctctactctgaccaatatgccctagttggagtggcccaactttcttgatgctctcttctgcttccatttcttttgtttcttcttccattctctgtttttaattttcctctcgtcctcggcttctcttccggctgttagtatcatttcattgacatcctcaccatctttgtcaaaagcattagcatcttgctaacttcatgggaatgtcatgattacaagatatactacgaggataataaatgatgacaaggattgtcttgacaattttggagagtgaagtgcaaaacatagctaggtaagccgtgtctagagttggtttgtgctagtgttttgcatgggttgctaactgttgcacttagacaaggcctaatcttacgattatgaatgcctttaataagaacattggtttctagaaattctctttatctgtaaacccataaaaaggaataatttataaattataagtacagaaatctaatattgattaacattgtcaacttaattacaaaaacaattgagcttagaagtagatgtttcaagttggagtcttggacaacatagaaattgaccaagaaagaaggtgacaagcaagctgaacatggccccaagcaggcccaaggtctgtcgggctaagttggtttgcggcaagcattggacatgggttgagaaagtttaccctaacatagcttgccccataaccctaaccagttatcctgctccccttgcaatcccatgctatctccaactcactcccatcccatctctctctctctctctctcgccccccacccctactggaagcttcccatcgcatctcttcttttcttcaatccctcttccctcgttctctcaccattcaaccctcatcaccgcctcctttttttttttttaatcccttctcttctggttcctttttgatctcaatcaatcttaatctatagtttctgatgcttttaattcactctaattaaaaatgttgtttcttaaggcttctatctccttaatctgatcgcatctagatttttgctattcgaatgtaccctcccaaggttggtctcaagataagtatgtgtgcttcgacacaggaaatcacaatcaccattatgagatagtatcctccttaataatgagtcgtagtaagagatttttaatatggtctatttctacaagaagcaccacttcctcttgggctggcaatttttgatacaattcttttacttgacctgatttatagattttgtttgccaccataactatttatagcattataatttatggacaagttttatcttttaaatactatgttagtactagtacgtcgctgtttgtattaatgctggctatttatatcatcataattttaatgttagctttatgattctacataatttatatattttttgtgcatagaatatacatatatatatatatatatatatatatatatatattnnnnnnnnnnnnnnnnnnnnatatacatatatatatatatatatatatatatatatatttatatttaaaaaaattcccgcacatagtctttgctggttacaatggtagagctggaggaaaagtaaaaaataattttcactcctccattacctcttatattttgtggactaaaaaataaaaataataaattttatatatgtatatatatagtatgaatacggcaccggtggccgtctttatgctatttgaactgcgtcgggaacatgagaacagacggctaggataccacgtgcgcgtggcatgggagaatccgaatttggcgaccgagatagagagagagaaaaaaaaaaccctcgcttatatgcataccatcgcaccaatttgagttttggctgcggacccgaaccctctccgagcgccgaaggagagaatccgcagcgatgttcggttctaccagttgtacgtctcacgctcccttgcctctcctcaagattcgatttcttggttccttctcttagatttctacgattctttttttctttcagcaagaatctcactcgagtttgtgagagatcttctttctttctgatttgaatttcttggttttgtttgtgtctttggtgcggcttttgggttgattgggcaatggagggttttgcatcgacggtgggattcaaatagtggaggtaggaatcttgatagatgcgacgttccttgatgttttgctagtaaaaaaaaataaagtaaaaaaagggcaactttacttgggggaaacaattctttcttgatttgcttcagacaatgacgatgcattttaaggcctgacgcaatgtatgcctgatacaaacattagaagttgaaatcttgaaaggtgttctgcttcctttgttttgctttgaaaataatggaaactttagcgtaacctttatagttgagctcgttgttggactctgttgatccgaagtacaggtcttcttgcttattttgttatactttttcagtcttatgggccctttttcttgttgaaatcctgcaaactggatgctgtttctcttcttatttgatttaggtatcatctttttgtccctgaggagcggatttggctagtttacaatgtttgagcaacgtgtgatgatttatttttcagcttttctgatggatctatcctgtcatgcagcttttgggcagtcatccacgagcccgtttggttcacaatcggtgattgggcagacaagcagtgctagcagcaatccttttgcgcagaaaccctttggtagtccaaatccttttggttctgcgacagggagttcagtatttgggggcacatcaactggtgtctttggccagccttccacaccggcatttggtgcttcatcatcaccagcttttggaagttcaacacctgcttttggagcatcgtcagctcctgcttttggcgcttcttctgcttcctttggtggttagtgcttgcttaaattcatagcacttgggttgatccatgcccttggtttcatttatacactgttttgtgtaatttaagtcaagtactatggtttttgaatttatgtgcaactttgttttggtttcttccatgaggttcatgctacctttttttggtagggctttttatgttggctgtccttaatcatttcattagacagagcatttgagttatcagtctgaagctatgaaccattaaactactagagtttgttgatgaagatatagtacttcctgactggaattttggaatggaaaccattcacatttgcagctagaagttaatggatatttcttgtgactttaataaactgtatttatcccgtttgatcttttctctgtgtcatttctcttcttttagtcttcctgcaagaattgaagttaaacttctagtgttccctctccagttacagatttagattcttgaagctgtatcccacctatgtggttgcttgaagtctatatcgttgctcattatttttaagctagattttacctattaagggtggtaatcaaaattggctgcctgagcaagcatgaaaatgggatagaatgtgaaggatttttgttgctcttgcagtgaaacctccctacaatatagacaaacaactatcatcaaaatataaacaagacaaaatccaatttttgtaaactatgaccttcttccttgatacacatgtacattcatacatatgtatacattcaaaggtataacacacagatatgtacacgcagatatgtatacatacatatgcacacatgtataaaaattgtaaactactaattgttgctaagggtcaaattatgctttacattgtcaggagatacttaacgggttgccataacaagttacattaggaaatcggaatttcttgcaccatatgctgtcttgtaaatgagacacttgaagaagatatatatgaaacatcaaagggtatccctactgtagtcacttaaatggtttttcccaactagatttttccctcctctttcttcctgaattgcttgaatcatagccattccacttttaatgataagcaacagtgcatgtggtcatctggatggatgactgtgcaagctaccaaattttagattgtattgctgatgctcaatttgattcccatcttctgaattgctcctgagatcttgccgacacaacttcaaccaatagggagcttaccatgaaaccatgaagaaacattacaatgtaggaagttgaccttagtgattagtctataactctatatataagctcatgtaaaaggaacacatctttctaaagtcctccaaactagtttgtggagaaactttttagaaacttctggttagcagcaggctaggtcagatatgcatcagtagatgtgaggaacttggactaacaagcggtcaaaatgttgtagaaaagaaaaaaaatccaactacttgttgatttgcagcatgtacagttacatgtgctaatgtataggataattattttagctaaaagggatttcagttatatgcatcagcattccaatctagtaggagttgaatatgactttatctagacacagttatggagtgttttttggtacatatgtgagaccatgtagtatgatttccaataattgtcaaaactggtgcgatgtaccagtacatcagtacctgttttaaatcattccacctgaatgtgggctagcatgctacttataactttgcgtgtctctgtaatatatttactttaaatgctagcaaagaaaacacgaaaaggtcctttcttaatacatgcatccaaaagtactaatctatattagtggttcgatctcacccaattagtcacgctagtagggaagaaatctgtttaactagttttgcttatttttaaatcatgtaaggattccttttttttaaaagcaagtgttaactagtactaggtaatatgcaattgcaaactccaaatggtattttcttccttatttctatctctaaactgtaaccgccatgaatcctcttaaaatctatgctatattttttcatgttccattcaaatctcctttgataaatatcttttctactttgggaatctcttgaattagtccatccatctcctccaaaagtgttgctttgtaccatcatttaaccctccttgtcgagcataaacactaaggatattaatatgttcttctctcttactctctcatcttgtaaattcttatttacatcaattcctaccaaggattcaagatatggtgggacatcccatggaacaccaagaaggggtaccagggtttgccatatcgggccgaaccgcctagtatggggcgtgttgaaccatcccggcggagaatcgagacggttccggcatgcaaaacggtacatgccgttgccaggaagaaaaagagaggaagagagagaaatagagagagagagggaggaaggaagaaaaagaagaaaagagatccgccggaggccctccggcgagcagccgtggccgtcgggtggcggaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttttttaaaaaaaaatacgagaaacaggggcggatcgcccccgttccccgcgctgatccgcgggaggccgttccgccgtccgatggccatggctgtccgtcggagggcctccgacggccccttcggcggatctccttccttctttttcttccttcctccctctctctctatttctctctttttctttcccgattttcttcgtcggttcgcctcggttcggaacggaatgaaggcgtgccgtatcgtaccgccggctggccgatcaggccatcggtaccggtacagaaaatcttgaggggtaccattccaagtgccaggacaggaccgtcctgccattgtctcagcatcccaattgacacattccagcatcctgtcgttgtcctattgtccctattgtctcaagtgtcgagatagggcgggacagtgatgcatcttcattccatgaaaaaattaggacaaccccgtttgatgggattttaaatcttgatttctactccatttttattctgttctttcaagtataccaaagtttataacctatcttaccaaattcttttgccttttctccgattcatttagttttttgcatgtgagctatgcttcttctcctcctagtcattttatctattagttataccgattttcctgtcaaggaccccctattccaagttactaaatgtatcctacttcttggattaacttctttactgatgcccatccattaaagtgtgagaatccttgcctacttcccatcacatcaaggcaccgatgtggcacgttgcttctaatgaattctttggttaacccttgttcactttctgctacactccatgtcagttgtagcgtgtcgctaatagggaatactgatgttcataggatctgactctagctttatgttggctatcaagttaccgcaaccctacttattgggcttgagactgaatacaaaacataggcggagttttagggacactatagtaagaaagctaataaatctgaatttctttgaaaaccaatattgcaatacttccatcgctttgcacaacttggtccttatcttaagaaagttcttctcagaatcaaaataaataatcaaatggaaagaattaacagaaatagcacatatacataataatagtgactcaaaatcttgaaaaagtttccagtttcggttttgccatttcaagcaaaacttaagagcattggatggtcatagaaatcttgttgagagtgcaaatttcaggctgtaactctgttttttgttctgggtggtgttaacatcccttttccttctataggaactccatcttttgttggtaaattaggttgatgttattccttgacctcttctttttctctttgatatgcagaaaattactactcaatctatagtgagttactggatacgcactcttgttctaatatcttgctatagtgtcctaattgaacatggatttgactggtcctataaatttgtcaagagattttgctatgtcactattggccccctatgccatagctcccactaaatattacaaaaaataaatgtgctgggttacatataatacatgcaaaagatgtcttaattgatgttgaaataataatgtgaggcatagctgaagcttcttatattttcttgatcatttgttacaattgttgcaaaaagtttctatttttctgaaaggaatttttttttcttgaaaaataattatcattcttgaagaggagatacttcaaactatgagcagatagatgaatatcaaggcttctgaaaagaagtagaccttcagtgtatttatttcttttcaagtttttatctggtctatttgatttggattactctacatctgatcaaaggcatttgatctgaatatctaagtttttcactttagatttggaattctacttcaagcatattaagcactgtaaactttgttccttttttctcttttcttttccattttcccatacttaatgttggtgacctttttggcattaacatgtttctgttgacttattgtcctttcttatatttattattttaacaaaagaaagatcattctactctcttctaggatcctctgtgtttgggcagaagccaccttttggaggttttgggtcaactgtcaaccagaccaatccatttgggcagcagacacagcctgcatttggaaacaacctttttggttcagctacgccctttggtgcatcaagccaacccacatttggggctactagtgcaccggcttttggttctacaagcacccctacttttggttctacaagcagccctgcatttggagctacagctgctcctacatttggtgccacaactgctccagcatttggtgccacaacatcaccagcatttgggtctacaacaactccactatttggcagtactggagctgcatttggggcatcaagcacccctgcatttggttccacagctacaccagcctttggtactcaaagttcttcagtgtttggatcttcaaacactccagcatttggtgcatccactactcccacgtttggatcttctacggcacctgcttttggtgcatcaactactccttcctttggctttggctcctcaccatcttttggtcaatcatcttctgcatttggcagcactccatttggaactactacatcaccttttggtgctcaaagctcctcatttggtgaggttctatctgtcatgcctcatgttgaatgcagctacttaaaatgagtatatgaaaagaaattttctcataagccagagccttcataaatcatcttacattacggagaatactgcaatagtccatatcttgttttcttcttccttcttttgctcttcccacaatttttaaaataacttttaattgttcttatatgacttttgaaggtactcaaacagcaacacctgcatttggtagcccaagttttggacaagcagcttttgggggccaacgggggggcactaggttagtagcttacagcccaacacctgagactgatggcactagtggcacacaagctgctggaaagctggaatcggtatcagctatgcctgcatacaaggaaaaaagtcatgacgagttgagatgggaggactatcagcttggagataaaggtggaaagtatattctttagctttgtcacatactttaatgtaattttaggcctttggtggtcatgcacctgagtcaccatgaagtatttatggagaaagcacaaaggaatataaaataggcacattaagttttcagcttaggcttaaacacctcattatagtttctatgtggaaaacagaaattgctcttgcttttagcaataatacaattgaaatttctgaataaggaaatgcctgcaagcaatcttcttgaatagacataccttggagttagaaatactctatgcaagtgttctggtttttatatctaactgttgactggaaggtgattgcttttgtttctaggtgataatcactagcataaaagcagtagccttgtggcttttcatgcacctattctattgatttaataattttttttctttcggatgtatattatgtcatagatttagctacaatcctacctagaggatttatttcttaattcaattagttggatacacataagtctcatattgtatatcacaatatggatactaaattgcctaaagatgaacaatcacccaaaattctacatgtgcatctctttaatacaaaaaaaaaaaaaaggatgtgtgataagaaattttgtttagatttattttctggaaatatccaaacacattgcatttttttttaagttttaagatgtgtggataatgatgaatgctggggattcgagtaatacggcctattatgcatgttagcacctttcctctacaggtaatgtccatgttatttttctgactagtaccaagaaacttctgaaacagttgatttgtggatttcgacacttttaagtgttgtagaataatccatggtatatattctaaatttggtggcctgtttggatggttgggcccaaaatcctatgggattcatggcccaaccaacaacaatactgaattataggctgggtttggcctattttacagcagtccaggatgttgggtcttttttttctccctatggaatttggaccagctactgaaaaggtggtcttggatagttgtaaaatagaccaaacccagcccataattctgtatttttggtggttggccacgaatcccataggattttgggcccaaccatccaaacaggcccttagataacttgtgtttccgactaatagattaaggctcgaattttcttaataagtttgtagttcatctctaaactttttttgtttttgcaagtaacatgcccatcatatgaccagctctatcatgacaaatttcttaacttcattctatattaacagtttcttttgtgactgactggatgagaataattttagttataaatgatagactacatgaaacttgatatagttaatttattttatttatgtagttgatgccaacaccaccagcatgtgttagcaatcatggtcttttaggttgcattctgacacaattttgagtatttgttgaggtttctctggtagtatgttcttattttcactcttacatttcattgttaaaatattacatttcagggggtccaaatcctgctggacagcctgctggagggactagttttcctgctgcaacacaacctagcccatttggttctccgggcacatttagtcagcctacaggaaaccccttttcttcatcaacatcttccaacccctttgggcctaaaactgctacttttggacagactggctttggatcctcatcgtcttcaatttttacctcatctctcaatgcttcctcttctagcccttttggctcaacctctactaccacttcattgtttggggcttctagtggttctgcttttggttcaagttcatctcctgcactttttggaggatcttctgcacctgctttcagttcttcatcctcgatttttggtgcctctggggctgggtcatgtccagcatttggttctggcctctcttttgggaacactcaatcaactggattgttccaatccacttcatccgttgggcaaacaccatctccttttggtcagtctgctacaggatttcaattgactactcctagttctggatcaaatctatttagcacaccatcaactggatttgggggaagtttgttcaccaattcagctccggcagttctttcagcgagcaatcctgttggttttggtcaagcaactgtaagtcactatagaaattctgttgttaattccagtttttcgactgtgtgcttccatttcttattctctatatccaccatgttgttagtgcatttgtatgccctattctgctgatcttttttggaagttttaaggaattaagcttctcctgcagccttctctttcaactgtattcccgcaaaccgccccttctcagacatctagtgcactttcttttggcaactttggtcaggcacagccaggtaattcacttgtgttgtgctttctctcttttattgcaactaatatttcaaggtattacagacgtgttattattgatatctcagcatcttcaggtggcttggccaacacatcaagtatcttcagtcagggcaccttcgctcaaccgtaaaatccaattcctgtcctgttctttaatgtaaattattaaataaatgtaaatagggttaaaggggtctaaaaaaattcagttctgtgagattgttgacacctgtatgtgtcatggattctgattatgtttaaatgctaccgtctcgttgtagcatctttcaaaaccagtaaaaacttgatgttctttagagttgtttctgacttcttacattgagctgtcagttattctttttgaaaaatcgataatgatattacatgttatggggtcttgataagcctgttgacctattttaaagacttgaaaatttatgattgaatgctgtattaagtgcaaggtaccttatcattgctattgatccggccttctcttttttaaatttttgtttctttcacacgttttccctaatccacttttatctgtttatttcatcttgcaatgaattaactattctttttctgattatttatttgttcaatgtgccaatgctgcacagcagagctgctactcagtctgctattgttgtgcaaccagcaccagttaccaatccttttggaatgcttccagcaacacctcagatgtccattggtcgtgtgggttctgcaccttcaattcagtatgggatttctacaatgcctgtaagcttactttcttcaagcctctgtatgtaaaaggggaaatcagtccatgtgattatctagtagattctacacacgtttcactaatttatttgtcccttttctataatcaaagaaacattaatatgcatcttgtggactaggtgcacaagctttgttaactgatttgtttgcttcctagtaggttgctgaagtgtctgttccagtcagaatctcctctttattggctcccaggcacatgtctcagagaaggattaggttgccagcaaggaaatatcatcctaaaagtgatggtctaagggtgagaacattttgtagttccactttttctataatttctttggcctgacaatcacaaacccgaggacttctaagagaagttgactgtttcttttccccagacatgctagtttcttgattattatatttagtgcttacaacatgcaagaacactacttgctcagttagcatctctgtgcaggtaccattcttcagtgatgacgaagaagcatccaccacacctaaagcagatgcttttgttattccacgggagaatcctagagcactagttgtccgtccagttgaacagtggccttcaagatctactacagacaagcagtttgggctgaaaatcacacctccttcagcgaatgaaaatggtataatatgactttgtgctgcatatgtaattgcctacgtgcatttgccagtaaatatagttacataagtatttttaatctattaccatgaacattgaagtttatatcaaaacacgacttttgcttgaatgaaaactggaacacttgattggtcactagagaactttattatttgatcaagccagacccatgactgaactcatcccaatgttcaagtagcaatattgattggcatggttaatgtgtcatcttatttcctgggtttatactttattagctatcgtcgttggttcctgtatcagggtctacagcatagtgataaacgttgtccaaaccttcactgtcacaatccaccccagttttcattaatcccaaacccaccccttcatgttttcctgacatgaattccagcttatccgatgcagtgccatctcagatcagctaatcatctttttatgtgcacaaggttggataatttgtcctctttagaaggtgctcctctgacttaatgagaagccttcagcgaatgacttctgagaaattgatatcattattatcggtcagtatcgtacgtctagcatcatctccaccttgtagccatcataaccaccatttcccttcggtatattctgctacttgtgcaccttccttgctgctacctatctgccttgaccaccccaccaccgttttcaatgtttggctgcagcaccaccgccagtagcttgctgccactacaaacttatccagttaccattggttctcatttattttctcctccctaggactaccagtgtctcaatgttactctgctaccgaagtgtgaaaattggctgctccaactactctgctgaatataatttgtttcagtatattttgttcagatttgggttctatctttcacttttctgcaataaataaagtgcttctcaaaatcaactatcaacccatttcagttaggttcacgcactggaagtgacctgtcagttcaataatgtgattagaccaataaaatcctaatcaaaataatgccagaatttacttatcagtaatcatccgaaatgatagtgttatgttgctttaagtcaggtcatgaagagcatgaggaacataaagtttttttaggatgattttctacctaatgataagggtaaaatggctttcttgtaatttgcattacaataatggcaaatgtcattggtaggtagttggagccgcatgttccccttttcaaagtcttcttctaatttcatcaatggagaagaaagagttaatgtaacttgtacagagttccttttctaatcaggaacacttgcactgtaacatgtttcggatgctagaaatttaaaattcttttagtagctggagccacacgtttccctctaattcttctaattttatcaatggagagaatagtgcaagtataacttgtacagggatccttttctagctgggtacacttgcactgtcacatgttttgcatgctagaaatttaagattcttttaaaccaccttcttcatcttcttgatcctttttgcatgctggaaagttaagattcttgtagaccttattgatcctttttgcatgctagaaagttaagattcttctagaccttattgatcctttttgcatgctagcaagttaagattgttctagaccttttagggtgtaacaatcttctttttcttcttcaaatttcatcaagggggaagaaaggctaaaagcattacttgcacagagatccttttctaaccggatgcactgtcacatgtctggcatgccagaaatttaagattctttagaccctttttttttctacttcttctgcttctgcttcttccaatttcgtcaatggagaagaaaaagttataatctgcacagagatctttttctaacaaggatacagttgcactatcgcatgttttgcatgctaaaatgttgagattctttcagacctttttgtggtgcaacaatctatcataagtcgtctggtggcacaagtgagacccttttctaaccacatgtactgtcacatgttatgcacgctagaaagtcaaaattctttttgaccattgtggagtaacaatctatcataagatatttaaactcgtcaatgccagcattaatgtctgctcccaactcaccttgacattgttacaatgtagggagtccggctgacaatgggcacaaccagcaacaaaatagaaatcacctatcaccatccaaagattccaaaccttcccagaagctgaatgggtttcatgctgaccgtgcagaaaaggcgagtcgtttgtcacccacaaacttctcctggcatggggctggtgaagctgcatttgtgtatgagcatggtgcagatattgatgctctggtgcccaagcttcatcatgccgaatattacactgagccacgaatccaggagctggctgccaaggaacgttctgaaccaggcttctgctgccatgtgaaggactttgtggttggaaggcatgggtatggcagcataaagtttgatggagaaactgatgtgagaaggcttgaccttgattcgatcatccagttcaacaaccgtgaggttattgtgtacaaggacgagagcaagaagcctcacataggacagggtctcaacaagcctgccgaggtgacactacttaacatcatgtgcatcaataagaagacagggctgcaatacaccgaaggccccaaagttgagaagtacgaggagatgctgatgaagaaggcccaagagcagggggctgagtttgtgtcatacgatgcagtcaaaggggagtggaaattcaaggtcaggcacttcagctcctatggcattcgagatggcatccgtgatatctagatttcagggaatgcctgttgttgtctctgcatctaggctttaagtctgtccccttttaatgaagggttggaagggtaaagtgtgattgtctcctgaggagaaactggaagcggtgctttgtttttgaggtccagcgtttatagactgtcgtaacttgtggcaatttttcttttttcagaaaaaaaaaaaattcactcttgtcttggtccaagggtttcaagggggagaagttctctttaatgaaaaactgtattttggtctcgatgacagagttctcgatttgtttttttatatggacgtaatttgacttttgtaagaacagagtattcttaaagaagctgaactcaaagccaagttgacatgtttgtttgcaaaattaatccttaacattcgattcgatttgggtcaagctggaagctggaactcgagtcaaggctgctcggaggtctggttccatttatttttgatgccccctgtaaaaaacatttcgctataaagacattgtctggagatttgatcgattaaattagtctgacttatcagcgcaaaattatgtagaataaatagcacataatgaattaagagtaggtcataaatatgtttatacattaggaaaattctgaaatcataaaattagttctagttttatgagaaccggacaaaaactttatttatgagctaggttggcatgcttgggaatatttggctcctaaatgctttctattgaaaaacggtcaatgacctttcaaaataaaaatcaatatcgttaagacatttgaattgcccagaaataaaaaatgatgtattttttgaaggccttttgcctatacgttaaatgaaaaatggccaaaataaataaaaaataaaaacatttcaataggatatatgtatgtatgtatgtacacacacacatacatacatacatatacatatacaaacatacatacatacatatatttcagttgcatctatgatttagaaacatcccaaacaagctaaaatttgatttctatatcctgtaaaatatttaaatcaagattaacattttggtattgtggcctgtttaatttttgtttacgagctatatagctaccactcatctatatcagtttgatgcataagtaatagagacctccatttttttaaaaaaatattctacgttgcaagtgttttaaatttcatagaccataaccaatggtgctgacttttatcatgagaggtcttacattacttttaaggtgtttagagagaaattcccttagaattgatctagtctaattatatataatgtatatatacgtcagatgtatatgagatataactggataggaaaattggttcacctgtctttaaaatagttgagagtctatccaaactcaagattcaagctattgaatataatctgtattttaaaaaacatatagtaatcaaactcaagatctctaacctaatcattaaatagatgtcaaatggatgattttgatagcatgatactgtgttttactatatcgcaatcatcaaaatcatggtaacattaaatctacccacattataagatcagtagatcatgatccattaagtgaattttaatttatgaaccctatcatgaatttgactatagtagtataattgatattgctcattttagtagtaattaattatatgatttctcatcactttttacggtatagattatctccaatagtttagattttgaatttgaatgaactatcattgatttgcaagatagatggactgattttctaatccacccaatgtatatacatacatatatacgtacatatgtacgtacatgcacacacacatatacatatacacacatacatacatatatatatatatacataattaatatatatatatatatatatatatatatatatatatatatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacatacatacatacatatatatatatatatatttatatatttatcgagacacacacacatgtgtgtgtgtttgtctctgaccttttaaaggttattatactttctttgatgctccaaaaatgattcatttaagccattatcatttcttttttattatttatcaaacaaaagtgcacagatgcatatttttttataatatgttaagaagaggttgcttatagggtcaaaatgtggcagagagagataattgggcagaaaaattgttacactaggattgttggagaagaattttcaatcaaaataagagaggaagcggctttattttgaggaaaaaaaataaaaaacatgcgaaagaaaggagctttgatttaagagagaacagaacattgaacgatattatcaaatgaccatcgagagattgtgcatttcaactttgggaggttagctatttatttatttatttttcaccacaaagtcatatttcatgaatctaatgtaaacctagttcaattgttcattggattttgctaattttaaactatacagaagtttcaagctatttagatcagacaagggcgatttccaaatttattcttaggttgcttgataaaataggaaaaaaaataaaagaattttaaaatgactcaactttagtattgaggctcagatgaagagcattgtcaagtctcgaatgatatataaggtacatagtttgtaatatattataatatagtaccgcaaatttggattgatagattatctaagagttgaatgccttgagtaggagaaatctagatccgaagaagagaaatttttagtggacactgccaatttagtgtctagtcatatatgttgatagaaagacccgatgtatcttgatgttctatcatcttatctggattttttgattctagtttctagtgatatcataagatggtttagtttgcagttggatgtgaggctctctagactaggaggtgttgctcatgtagcaaagtaattttggataaccatgcatctagaatattctaagctaagaggaagtgggaagaatgtttcaagtagatagagcaagagtcagaagctggttctaacatttcagaagcaaaacatcatctcatggaatttctgctccaataatggtttgttctagctagtagccttctttgtttttttttttacttttatagatcattatttttattttttttactgcattctttatataatgccatagtgcaaatactattgaagttgcttctcaataatagaagataaggatgaaagtggatcaaacaatatccatatgaatttgttttcatatctaaatttattagaatataaatagaaatttgagcatctaattaatatccatatatgtatctacatccgttagaaaaaatgaatatagaaacagatagacactatctgatctatatctgaatatttaattttatttaaaaacttatttagctttatataatactcataattttttaagaaaaataaataatcatattaacatgctattaacttgatttatgatccacttaataagatctttgattttttggtcataaaatttaattatttattttagatctatgtttatatctacactttagtgcccaatttgtatccatatccatctaaaataaatatggatataatttttttttgcatctgactaatatccgcgaacctatattgatactcattgaataaaataaatatgaatatagatatattagtatccaatccatagccaatccattttcaaccctaatagaagaagatatatgcatctattactaagatgagtaacaaaaatgttgtcaaaatagaaacacttgtaatgcaagtcctatagtctttcattcattttgctcttctatttcttgcaataagcaacatatgatgttaagtttgctttagcaagaattgtagtagaagaggatatagctaaaaaataacatggaagttctttagcattttaattaagagataatcgcccatctttttacttatttctttggatgctctgtaacacaggaaagcaataagagcaaaaggaacttcaaattttttgagtttcatcattttttaaatcaattttctttgttctctctcgaactagagctcctttctctcttattttttctttttcttttgtttcttgttctcttattttgatagaaatttctctaataatttactgatatagtaatttttcctcccaagcatctatctctattgcatcttagctctgtaagtagccttttgttgtcatatcataaaaaacataatatttgtgtagttttgtttgattagcaatagaaaaagtgacattaacgacttaaatgaactatttttgtaacgctatgaacaacattataacttttaaaaaactagggacttaaataacttttagcccaaaccttagggactaatttagtaattaagccatatatatgtacatgtatatatgtatacatacatatttttcatttgaaagccatagccccgcatcaatgatttgggccattgaaaatgatctactatctctagataactttcaaactaaaaactatgtgagttggcgatctctaattcatgcatttaggggtcaaaaaataaataaattttttgatgataggtcaaaaaatatatatattattttgcatcatttatacgtactatccattttttaaactaggtagagatatctaatatacggtctcttctttataaaggtgtgcttttgcataattttagttaattttcccccggagcttttctttgggtttctatgttctcttttttgtgagaaagaatgttgatatagttttgtaactagttgaacttgtttttattgtggatggacaaggttgacttctaaaaaatatttttcttttctcttcattctattaacttgctttggttttttaccgccaccccatccctcgatagctaacttcgatctccaagtggcaagagttgatatcatccgagcaagcatctacttatttgtttgtgaatgaacaaaaaatgcttagaatttcgggccaaaaaaaaagggaacaggaaaaaaattgctcaggctgttaaggaccaacttttatgggaaatattgatgtgctaacaattgaaactccaagaatttcttcattgattggctttgttggcaactaagtgcaaagctagggagggctgactgggcttaagaccataaataaagatatttactcattaactctcaaatcatcaaatcaattgtacctttctcatcgattttttttttcccccaaaaaaatcttattgcagccagtcggttgactaagaaaactcaaaagtttagcaaccttggcagaggaggctgcccaacctccaaagaggtatttggcagttgctagtctggaactcttaggacgatgtatttcctactcttaactctcagagaaaccagtgaatatggatgaaagtatgtaaaccgagaaaaaaaaaggaaaaagaagcaagtatgcgatttttcttgtatggttcaaggtcttggcttataacgctagatgcgtagctccttaggccttagaaatagcaaactcaggacaagttaataagccactctcaagcctcaagataaaaatgctagcaggaatggaactaatgttcggaaaacagtccaagtggatgtatccgacgtgctcgtctgtttgtaagacaaggactccagcagtagtttaaacaaaaaaatactccacaccacgagagcagctggttcctccttgttttctcacatggccttcaataattgtggagtcgatcggttctcaattatcttgaagccacaacattatcacaactatgcatctcttatatccaagtatatttatatttaaacatgcggaatacgaatctatttttttcatattccttgatgctcgttactgactcttccagaaaacatgagctggtcaatcgtaagtctttttttttgctggctcatcccatgtgttatcaaaaaaaaaaaaaaagggggtggtccggtttcaatatattatgtacgattcttttcagtagttgaccagcttcatttctaactggatttgttccaatgatgaaatgctaccagctccaagattatcaccatggtattttctatatatctttaattagtgctcttctaattaggtaaaagatttcaggagcatctatatatcgaactgtcatacaccattctgtaaggaattaaacactcatcttaaccatgatgccctatatatgttcatccttcatcttttattttcttttgattgtttgttcatctgtccattaggagcaccgccaatcaattcaaataaatgatgcaagaattatccgcatcggacactggaaaaacagctccggttgtctgaaaataggtcagctatttggtttatggaagttttttatggattagatgtgccaaatatattactcatgcaatattataatctacttttcacacctttcaagagagtaatgttttgtagattttctttgctcgttcaacatggatatccattacttactgatcattatccatatggtattcacaacttggtttttcatacagctatctcagcgataaaattttgcagagaagctagatcgggtcaaaaacagatgaagatgagctgaccgatggccagaattagtgcgacttctgcacaatatgatcgtttaaatgggcataattttcaatccaccccctggaagaatcatgcattacaatctagaatggacagtgttggggtaggttccgtcgcttaaccgactatctctggaccgattaaaaaaattgtaccgattaaccgacaatcaatccagctcggatatataaaattccccccaagttaggtcatgtcactcaagcaccatgctctgagcggctagctgcgcggcatgatggagtactacgatctcattaaatgcgctctcaaggatatttattaccccccacacttgtcagccgtacgacaggacatgatcgatatgatcgcctgtcctctcatcattcattttgatctctctataaatagaagtaagcggagacccctccaagtatgcatagatgcactatctcaaactcagaaactctgccattctttcttcttggaccatttactgatttaggcatccaagaatcttcatcggaatcatctccaatggaatttattttgcagattcttcttttttggcgttaagcgaaacccagcactcttttcttctaaactctattatcgcttttcatcttgatcttgactggtgcaccttcttcgaagatgatatttcattcatcgacaatcccatcatcactggtcggcttttgatcggctatcgactatccaccggggtaaggccgcaacaggcatagaagatccgaatggtttcgtacctattgatattgttttggctactgtaatctttctgacataaacaaaatgttttagcttggggttgcaacttgcatggagggcagtggtaaagcccctcgccagtctcaaaaataaattaataacggcactgtatatttgatatcccgaaataaagtagacatgcgtttatttatttatttgacttttgaaggaaaaaggaggctcgaaaagccacccatttattaaaagaagtagacgagtatttgttgtgtcaaacgaaaggaacaaatgaacaaaggatttctaaggggaggccatttccagagcaaatatttgagcttgggttgctgattgcactccagcatgtgttaatagtataaggatgatacatagagattggagcaggtaaaagccatgaaacccatcaacgatcacgctaatgcctttaaagaatggtgcacctattcgactcgtcaatccagacgatgttgccatgactgcccccaggcttgcatgtgttacaacatggaggcaaaggtttgcactccttcttgtcatccccatccttcttgccatccttcttgccatccccatccttcttgccatccttcttgccatccccatccttcttgccatccttcttgtcatctttcttctcctccttcttgtgtggcccgacactctcaatctccaccatcttcccggccttccgcagctgttttacaatgatcacagcatccaccgcaccaataatcgtcacggtattcttctcgacgtccacagatattgaaatgatccctgtcatgccagcaacacaatttaatcacacaaaaaaaattaattgattaatttgcatatataattcgatgaagcagatagtatatacgttataacatggcatcattgatcactcaccatcgacttttgcgactatcttcatgatgcaggccttgcacttgcagcacaagatgatgatcttcagcacaatcttctgcacctgcgcgtgtcggacgccatggaaaaaagtttcagactgacttgccagatacactaaattattataagcatagtgcacgatggtacgaatcaaactacttcaccatgaaggtttttcaacacactctctttcagaaaattaatattctttatgttatacttattgtctctcaatggacgtatcagcaagctctccgcatatatatatcaaaatgaaacctgacgacactgacgtatatatgtctatgaatgaaagtgatgaatatattctctcatcgaacttggatcagcaactgaattacgtaacgtaacccacaccaagcgttactaatgtataacgtacgtagtaactatagacattatgatggaaaagtactgtgataatcctagtcaagacgaacctgcatactggcatgcacgtgcaaagtgcgattgtttgtggtggctccggccaaagagcttgttaccaaagaaacaagaagaagaagagcaaattaattaagagctatgggagctcccgatggagtcgttcgagtctgtatatataggagcaccgtgggagggctgtgctcggcccaagtccttgcagtcatctcaaacaccttttattaaaatggccatcaatcgtgaattattaggtcaattaggtcggtagccagtttatctatggatttggtggcgaacgcgggtgcagaagcacatgcaatgcgtcgcttagcagtcctcacaagattaaagattaatggctaagggatagaataatgagtggtagccaacccctatatatggatcctttagttttttaattcaagcgaggtggggtttgagtttgacctgcgagattctaatgcatgtgattgcagctctatttgtttagcagagcgaccgcagtctcggagggaggaaactaccgggccatgaggttcttggccgggttggcgagcttttactttagaatttaatttaaaactagggttctcatgaccttggctttgtcgcgagctccagccgacgaggcgcgattggtccttgccagctgtgaggtggccgctgaataatgatgataataattttgccggaccagagtgtatgggtgtccctagtattttgaatccgctagcggacaaaattgtggaagaagcttctctcgtctctacgagaaataattgatgctaaacccgtgcttctttgttccttttttttttttaaatccttagtcgacctctttcaatcgagatgtatatgtgtgcagctatatcaatgatatggatatttgattaatgatataacacttcagtttaaatttcccattatccatcttggaatccggaggagcagatgatgtcggagacagtatgcgtgtgtacctgtccttcttgagtttaaaatcaatattaaggcattcaaactaaaattccactccatccgacttgcttgtttaaccttaaaaatatgtaaaaaccacaactatatcttttagacttctaacttaaaaatcaatgattctaaaatgatatgaaaccatattttgctatatttgaaatattaaaattcaacttatatatattgaaacatatgcatatcttgagcaataaaatagattctcaattttcatattcttttatgtattttagcatgttagtataatagaaagcatccatttttatatccgcatgatgtatagattagagatcaccaaaatatataatacttgatttggaagaaccttagtgatgtagatcatgatcggttgtgtagatattctacttaaatgctttgttattgactttggactcaagaggagtgaagacctcttctttaggagaagtatagttctcttagaattttatagggtgctcatgtatgtagtttcaaaactcttttgaaaacatagcggaataatagattaaaatctttcaatctagaacatgcaaatattaaagcacctaagaatctagtttatatacagaaaataacatatgctgattttaatctaaaaataaaatatgtgatcggatcacatatctgtttcattttttctttcctcaaatctggatctgtaagataaacagattctctcttagccacacaaatatccgacctctacaggtatccatacagaaacaacttggattgctcttcttttcttctttacatgcaattgatcaatccttgatctgcttttggatcgatccttttgatcaactccttgaccagtctttttttcttccttggattttttttgatgtagaacaaccaccaaccaaaactagaaagaaagatgggatgcccaacaccttttgggcaagtggatgctattagaatgcagggtggtttcatgcatatagtttaaaaattttgcaagctattttatacaacgaaagtaaattaaattaaaattttttaatttaataatgcaccagatctcatatgtaaactacatgctagatcttgacacgaacatgtgactttgatctgaaatttaaaaaaaaataaaagatatcaaaaaaaaatggagatctaatctccataccttcagatcctgtggatgtctaggattcgaatcgtacccgtgcaaacacccgacctctgtaagtattcacacggagatatctgatcgaagcaccgagatcaccggtatactagcaccttgcagacttcgctccttagctttggatctgaatcctcttctagagcttgaaaaagataaaggctgtgcgaactcttttgcatagatctaactggatttgatcagatcaccaagaagagaagaagaacctttcttcttctctttctctctctctttttctctcctttacatctgatctcattagatctttgggcatggaggttgaaggaagaagggagggtggtgtttgaaaaataagttacaatgcccaaaaagaagctgttgttgtccagctatgcaacccaagaggagggaagggtgaattagatttttaaaattttaaagttaatttagaactataaggattaaataacaatgagcaggttatatgcagaaagtgatttaagcaaggtgcagaaatgagaagcaagaatgcaagaaaataaagaaacttagaaaaagaacaagtaagcacaacacagacaatcaagatttatagaagttcggtgccaaccttgcacctacatccactccccaagctcttacttgaaaaattaaatccactaaaatgtattcaacaagaatacaacgtcggtaccttcgactctagctatcctaagctagaacatttatttttcagatacaagccaacccaaatacaattcgattcaaggttcggaccaaccttttcaaattttggaacccttccaaaactaaggatcaagacaaaaatagagtataagagttaatcacatggaaatacaagtttaattcctttaatgagcaaattaaaattttaaatacactttacacaacaaggaagaagcttttctgatttttctcaaggttgttgaagacttgaatgagctcttgaggggttggtgaacttgaaatgaaagtttcttttgcttgaagaggcctttttctttagagctgaaatgaatgcttgaaatctcttgcttttttcctcctttaagtgcctttatatcttcaatggatcgtggagagtaatttgaacaggattagagccattgaagtgcattaaatgaacattaaatatagtcaaaataaactaaaaaattagccgttacggagattttctatcgtaggggtcgactcatagggtcgacctctgtggtgcagaacagaaagtcactgttctgtatctttggcttgcacagtaatagaggtcgactcatagaatcgtctcttttgggtgtgccggccaaaaatagtatgccgttcagcccttttgacagggatcgaccctaggagtcgatccttttctttaaacttgattttctcttaaaatacacatccaaaaaatatgaaattatctctaatagatcacaaatcttctgttcttgctcttgaggctttcgaatcagaacttgataaaattacgattttgtctctgaaatataataaatctttttccaagccaaaataattattaaccccttcaaatattttataatcatcaaaattaattcaaggagcaacaatctctctctttttgatgatgaaaaaatatttgagcaaaaacaaaatataacatataacatatataaagcatagattaagaattttaaatttatgaagatacgttacttaaacattatagccaattatttgaatagaaagtatcatgagtagtttgaagattagttttaagatagtttatgttgggtataaaataccccccagccgaagttcgtgacaggagtgaccctccggggattctaccgacttccgaccttcggctacatctcttcgaacctctctggcggccgagcctctgcaatactcccaagttttgccgatggataagcccccaccagcgtcgatcggattcttcacgatggacggactccacccaagttttcacgatgatcgaccgccttctagacttcgtccggatccctacgggagccggacttcatccccgactccggctgcaggaagacttcgtccggactcctacgggagcgggacttcatcctcgatttcaattgcaggtagacttcgtccggactcctacgggagccgaacttcgtccccgactacaattgcaggtagacttcgtccggacccctacgggagccggacttcgtctccgactccggctgcaggaagacttcaccctgactcctacgggagccggacttcgccctcgacttcaattgcaggaagacttcgtccggactcctacgggagccggacttcatccccgactataattgcaggtagacttcgtccggacccctacgggagccggacttcaccttcgacttcaattgcaggtggatttcgtccggacccctatgggagccagattccgtccccgactacaattgcaggtagacttcgtccggactcctacgggagccggactccgtccccgactataattgcaggtagacttcgttcggactcctacgggagccggactccgtctccgactacaattgcaggtagacttcatccggactcctacgggagccagacttcgcctccgacttcaactgaaggaagacttcatccggacttcgcccccgacttcaactgaaggaagacttcatttggactcctacgggagctggacttcgcccccgacttcaactgaagaaagacttcgttcggactcctacgggagccggactttgccctcgacttcaattgcaggtagacttcgtccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagttcacgccaaattcaaattagtaggaggcgtggcccctctaattcatccatatattggtgcgcacaaattgatcacatcaactggcataatcatggctagatccaaagcatgtaggcacccagcaattgagtctcttgactccaatttcaaattcaatttggattagatctaatgcatgtaactaatttggtctaattcttatccttaatccatgtccaaagaggaattggatttaaccatatgttagtaagacttttctaaacccaatagaattttactaaatcccaatccaattgggacttcataagtccaattggtcaatccaaattagtttccttgtttgtgtgactttataggtttaattctgtctggtagtgagatatactatgatctctatcataatatcattgaaactcttttcaatagatcgtaaccattctactctcactcaataagcatcgccgatccaaaataatccaagtgagctctcacaatctatcagtgacatctagcagtatgtagtggcaagccagcagaatcgaataaagaacctttaggtgtagttctcatgtgatttagttcctttatcgtgagtcccgacttgatagcaggtcatgaataaatcatcaagtctcaacatcagtcatatgatagattcgattaacttaagtctaataataattcatataaaaattttttttcatcaatcacactgctatggccacagacttaaagacttaacctcttaaatccaatagaactacttctttctattaaaattgatagattccatctagaaatgcatcctgctcctatagtggactaattgtcgccaacatacactataaggattcaagtgactaagagatcatgtttctatgcaatcaaactctaacagcctcactgtgagcagtcgtggcactgcagatcaaaagatcattcacacaactacagcatcaagatgattactgaagattgtttagaaatctacatgatctcttgtatggttatgctcagtactagttgttctcttacaattatccatactttttgcttagtatctctatactgtagactagagatccatctatctcgaagaaagtgatctgtatgtcggtctatctagatcgatcaccatcaccatgatgatgttatgtctcaaaatcaatcattagacgattgtgctcatattgtaaagtatatataaatttttattaataaaaattatttggtatttttattataaattatccatttttgaactcctgtgttgtaataaaattcttaggactataattaatcgataaagaaagatttatcgttaagtccctaaaatatttatgattaaatgatatgttattaataggatgatagcattatcaagtatcgatcgttacgtgccatatgagttggttgttctcttaaccaaggagtgtggagatactattatggcatgcaaatagaatgtagaagtatattcgcatcgaatgtgattatgtgtcgagcattctgctgtcaagagtagctcgtaaaaggtatgaatataagtatccctccgacttgagaccaccacagtgacttgtaagcaacttactgtactttagtaccggaccatctgagtttctaactcagtgacggaaggctattgggtgcagtcaaatacttatcaagtcggtgtgcgagtcaagatggaattaacccctctgaattagtaagagatatgcatcagtgtatttcaatttagtaaaatcttgatcagaataatccataagatggatttgaaaggttgagatacaatatggttgactaaattaggattgacagttaaatcctaagtcatcttgagtatttggattaaagaaatgaattatatgatgaccatacaccaataggttctagaaggttgctttgcaatacttcgacctattcgatcatcggatcatcattgctagatggttatattgattagtataaaaagttattcttatgctatcaacttaggttcaaatctatgaggtcatacatattagaagatttggttagatctgatggctgaatagtctaattagattatgactctggtgaacagtcctactcagactaggactctgagggagagtcccattgggattgagattctactatttatgaagaattaattaataattagattattaattgactcaatttgattgaacaaaaaattttagatcaaatctaattgaattagattcagttcgactctgattgggtttgatatgatcgaatccgattataagaaaaatttgattctgattcgatcagaattttgactctattaatttttaattggattaaaaatttgatgagatatttaaatttataattagattagattcattcctattagtaggttcaatctaaatttaatttagattagaattgaattagaaatgaagagtccaagtcaaactaggactctatccttatctcctgcaccactatcgaacccttaccaatttcttcatgcctaattggatttggattatgatttttggcatcatgatagagggtctaataagagtgggtggcaatagctgatgagccataatattatctcttgtctaattcgaatgcgatccaaattagagataagaggtaaactaggaaaaaaaaattttgtatataaaatattattgatgtcatattaatttttttttatttttcttagagaatcttttggtatgtgagattttagaatccttctccatatcttaatggtttttttggaattttttgggatgccaaaaggaggttttggcattgactcttggtgcctttccttggaaaatcctaattcctagtctgtaaaaagaggtcctctctcttggacgtcccatgatcaatcccttgctgatttttattttcagagcctcttctcttctttctctattcttcttcttgatcctctcttgctttgaagtatccaagatacttgaagaagaaggaacaaatcagctatcgaagttgcttgtaggctagcacctccaagtctctgatctgtgcctgtctttgcatggatttttctgtagaggtcagatgactctgtgtggctgcaagcaccttaggaacaccttctccaactattggatcagagaaaatcaagatctaatttgtttggtaacgatctctaatttgttttgattcctatggtagatctaatagttggatctagaatttcagcatcgatgagatcgatgtaatttttattttcaaatctaaagtatatatttttatatcaaatattatgatgtggtagtctaagatagaattttatgcatgtgattaagattaaatcgtttaatcttttttttcgttgcataaaatttttaaattgtatgtactgcactatcgcatatttctttcaactggtattagagcatgattattttgatataaattaatataattttagatctatttttttatttaatctgattatttataatttagattagatcaaaattaatttatttttagatctgattatcatctgtttagattagacgttatgagtagcaaagtactcggattggataatcatcagaccgttcggtcatagaagtaagtaagattttatgaccctctcctcccattcaatggggtactcttatggcatataggggtgccactgtaaggtctcacgaagatgaaagcgaaaagagaaaacttactttcttccaaaatcctagatcttgaaaccttaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatttctctagtacaatagttgtagatggtcaagtccatatctttgattaaactatatggatcttgattatggctcagtgattgaattcaaatcattaggttggttaaatcgaaactaattaaccaattggagtctaagataagtttggcatttccatcggtagtttttaattgagagtggcttacctgatcattttgatggtatctaaggcaagcttagcagatcctcccatcaatctcacttatctggtcaatttggtgaactagattttgattagatcgctaagtgatttgagttagcccatgccattaaggttgatcagtgtgactgatctaggtgccagttcaatcagcatgacctaatccgattcaatgacttggtggagtcagtaggagggttgtggtctgctgattgatcttttcttctctcttcttctctaaactgattaaattctctaaattattaggtctctaaaatgagctagttatggtgataactagatcatagctttctattaaggtgaatggtaatgggtcaattatttatgattgacattgtaggcgccatccgtctgatgtttattctgaatgatggaattagtatttatcatatgatgactctgttaaactatctgatgatcattgggttgatcgagccatcctcggatctaatcactcattggttagaatcactgagtaggttcatgttagtggtttgacttaaccgaaacttttagtggatgcccatcgcctactgaaataaaatctggagctaaattaaatattaaatattatttagagaaataattgattgagaacctatccatatgtgatatgggttgatcgagccattctcgtacctatatataatctgtgtggattctagtatccgctaagaaattaagataattttttgaattaaaggtagaggctaccaattcgtataaaatagtggaagaatctttagactaaaatccatatctttaggatcaataaatttatatactaattaggttttgtgttttctttatgtgtgctaatatggactcaaacttatcgctccgatcactgttggacagtgagaagtttactggactgaatttcgataattgatatcgaaagttaaagatagtcctagagcatgagaggattctttatgtgataacggatccgacatcgaggtgcagtctgggatacttatttgaagtggctcaacgactgcattatggttcgttgcatcatgcgggcttccatgaatgacgagttcaatcgaaagtttgaagaggctcagtcagagaaaatgctttaagtgttgagggattcctttggtactcctaacaatgttgagcggcacaagactagttgtgctgttttcaatattcggatgagggagggtgcatctattaccgatcatgtattgtacatgatcgagcagattgaaaaactaagcaaactcggcttctccttgcatgaacaactggagaaggatgcgatcctgaactccctatccaagtcctacctactgttcttcagtcatttcagaatgacgaagtccgtagtcaactactatggtctgttgggattacaacagacttttgagaaggatcaccagctccacaaggagatggtaaatttagtggaaggatcttctttgggtaatcatcgtccctttaaaaaaaaaaagaagaagaataagaaggtgtctggtgctgggagttagtctcagaaatcaaagttcaaggctgatcaaagttagacaaagtgcttcttttgcaagaagcaggatcactggaagagaaattattctcagtatattactttttctgatccgagcaagccaaagacgaagcagcaatcggttgctggacaaggtacttatgtgataacatcttttaacttctctctttttgatataatgacctaggtattggataccggtagtcctatttacatttgcaattggttgcagggtcttcagatcattaagagctttggagctggcgagagattcttgaatattgaagatggaagatcagtttcggttcgagcctcaggaatcatcaagcttgtattcacgtctcattacgttgttcttgatgagtgtcattactatcctaattttcttttaaatattatttctgtaggcctcttggtcaattccaattatgaaatatcaataaagaaaaatttttgtaatatcattttgaatgatgttacaattttgtgtggatagttgaataatgatatttatattgtatctaggcctaatgtaatgtacatttcaaataaacaccctagaacagatgatgtcacagatgcctacctttggcattgtaagctaggtcatatcaacaagaacaggatgaacatgttagcttaagaaaagattcttaataaagatgattatgaatcattatctatctgtgtgtcttgtttgcttaaaaagatgaccaagtcacctttcctgaaaatggtgaatgaaacagtaatgtgctgggtctgatacatactgatgtatatggacccatgagtacatatgtcagaggaggatatagctatttcattatattcatagatgacctatctaggtgtgggtacgtctacttgatgaaatacaagtccgaattatttaaaatgttcaaacggttccataatgaagtagaaaaataaactgaaaaaaatattaaaactctttgatctgtatgaggagatgaatacctctccaatgaatttttgacatatctaggagagaatgagattctctcccaatggactcctccagagataccacagcataatggtatctcgaaaaggagaaatcaaatcttgttagacatggttcgatccatgatgggatttgcaactctatctatcttcttttagagatatgtacttgaaacagcctgtcttgtgctcaataatgtatcgagcaagtcagttagtaagacatcatatgagatatgatcaggacgtaggccaaacctctcttactttagggtctggggttgtccgacttatgttaaacaattacaaactgacaagctcagtcctagatccgataagtataattttgtaggatatcccaaggaaatgagaagatattacttttacttgtctgctgaacaaaaggtgtttgttagcagtaaggtatactttttgaaaaaaaaaatttaatgaagaaataagtgcctctaaaatcaaacttgatgaagtttgacaggtagaagaacggacatcaatgattgaatctgaaccgaatttgataagatcaaacccatagcccaatgaacaaatatccttaaggcgatctggtagagtactgcgtcagccggataaatatttaggtttcttgattcgggatggagattctgttgaactcgatgagaacaatgaggatccgatcacctacatggatgcgatgtagaggtctgactctgacaaatagcttgaaatcatgaaatctgaaatagagtctatgaaggtcaatgatgtatggacattctttgactcatctgaaggggttaaacccatagggtgtaagtggattttgaacaggaagaggggtgcagacggaaaggtagaaatctataaagcccatttagttgtcaaagattatcgtcagtattatggtattgactatgacgagatattttctcctatgacaatgctcaaatccattcggattatgcttgtgatagcagcatacctggactatgaaatctagtagatggatgtgaagactgcttttctaaatggagagctgaacgaagaggtgtatatgatacaacctgaagggttcacatccacagatgagtccaaggtgtgcaagctttagagatccatttatagattgaagcaagcatctcgaaattagaatatatattttgataaggtgattagaatgtatggcctcgttaggaacggagaggaaccctgcatatataagtggacaaatagtttaataattatatttcttgcattgtatgtggatgatattctgttaatcaaaaataacatccctgcattacagaaaataaaagtgtgactatcatcatagttctccatgaaggatctgggggaagcagcctacattctaggaatgaagatctataaggatagatctaagaggctgtctgaactctctcaatccatatacatagataccatgctgaaatggttcagcatgtagaattttaagaaagactatcttctaataggccaagaaatttctctttcgaaaggagattgtctgacaactcctctagagagagagaatatgagtagagttccatatgctttgatagtgggttctattatgtatgtcataatatatacgagactagacatggcatactcactagggatagtgaatagataccgatttgatccaggagaaaatcactggaagatcgtaaagatcattcttaaggatttgagaaatactaaggaccagtgacatgtatagtaaaactgacttgaaactgatgggattcaccgactccagctttcagtcagaccataacgatagtaaaaatgtatcgaattatatttttatcctaaatggtggagtaatatgctaaaaaaattttaagcagcacactgtggcaaactctgtttacgaacagtatatcgcggcatccgatgctgtgaaggaagctgtatgattgtgaaaattcatcgataagctcagagtgacaccctccattgatggccctgtcttgttatgctgcgataatactggagccattgctcaagccaaggagtcgagatgacatcagtgcaccaaacatattctgcaccactatcaccttatccgaaagatcgtggatcgagatgatgtcgaccttaaaaagatcgacagaaagaagaacctgaccaatttatttactaaagctcttgaaatcaaggagtttgatgaccacaaatcgaagataggtattcgatactgtaccgattggctttagtccaagtgagagttgttgaaaaatatgtcccaaaatcaatcgttagacgattgtgctcatcttgtaaattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaccatatgccagtaggttttagaagtttgctttgtaatacttcgatctattcagtcgttgggtcatcattgctagatggttatatcgattggtatagaaagttatttctatactgccgacttaggtttgaacctgtgggatcatacgtattagaagatttgattagatctaatagctgaagagtccaattagattgtgactttggtaaatagtcttactcggactagaactctggaggagagtttcactgggactgagactctactatttttaaagaattaattagtaatcagattaataattgattcaatttgattgagcaaagagctttgaatcaagtctaattgaattagattcagtttgactctgattgggtttgatatgatcgaatccgattataagaaagatttgatcataattcgatcagggttttgactcagctaatttctaattgggttagaaatttgatgagatatttgagtttctaattggattaaatttatttctattagtgggtttaatttaaatttaattttaattagaattgaattaaaaatgaagagtccaagtcaaactagaactctatccttatctccaatggcactcctgaacccatgccaatttttccatgcctaattggatttgggtcatgatttttggcatcatgatagagggtccaataagagggggcggcaatagctgatgagtcataatattatcttttgcctaattcgaatgcgatccaaattagagataagaggtaaactaggaaagaaatttttcgtatatagaatattattggtgtcatattaatttttatcttatttttcttagagaattctttagtgtatgagactccaaaatccttctccatatcttaataatttttttgaaattttttgagatgccaagaggagattttggcattgactcttggtgtcctttcttggaaaaccctaattcctagtcgataaaaagggatcctctctcttggatgtcccatgatcaatcccttgttattttttattttcagagcctcttctcctcttcctctattcctcctcttgatcctctcttgctttggagtgtccaaggtatttgaagaaggataaacaaatcagctgtcgaagttgcttgcaggctagcacttccaagtctctgatctgcacctgttttcgcatagatcttcctatagaggccagacgactctgtatgactgcaagcaccttaggaacaccttctccaactattataccagaggagatcaagatcaaatttatttgataacgatctttaacttgttttgattcctatgatagatctaatagttagatctagaatttcagcatcgatgagatcgatgcaatttttatttttagatctaaagtatatatttttatatcaaaaatcatgatatggtagtctaagatagaatcttatgcatgtgattaagattaaatcatttaatcttttatttttgctgcataaaatttttaaattgcatgtactgcactatcgcatattttctttaataaggactcaagtggctaagaggtcatgtttctacgcaatcaaactctaatagcctcattatgagcaatcgtggtaccacagatcaaaagatctttcacacaactacaacatcaaggtgattactgatgattgattaaaaattcacgtgatctcttgtatggtcacgctcagtactagttgttctcttacaactatccatacttgccgctcagtatctctatactatggattagagactcatctatctcgaaaaaagtgatccatgtgtcggtctatccggattgatcaccatccccatgatgatgctatgactgaaagtaatttaagaattaattatacatgctcttaatttttaattctttgagaatatgtatcgtaattattaatttcctgaatgattcaagaacatatcatacttgaataaaaataaaaattatctttttattgatcaaatcaatattttaaatataaattttgtgccttagaaaaatacaatgtgtctgtcatattggcttctagaacatatatctaacaatcttccacttgaattaaagtaacttagccactaatctaaatttcatcttctcaaagtggacttccatcttaggtgggctcaactactttgtcagtgggtctgtcatattattcgtagagtctactcttcgcatctcgatatattttttctcgagatagtcacgtatgatgtgaaactaccgctcgatatgcttagattttttataagatctgatctctgtagcaagtgctatagctccgttgttgtcgcagtatagtggcatggcatccaatgtcattacaccaagcttcatgatgaattttttgaaccagaagccttcctttatcgcattcgaagcaacagcatattcagctttcatggtcaaatctgctatgatgtgttgtttggaactctttcagctaactacaccatcattgcatacgaacacatatcctgatgtagattttttatcgtcaggatcagatatgaagtctggatcgatatatccctcgatctgcaactcagaccctcctcccaagatcaagaacttttgctccaagaattgattttgatgatcacaattcatttgaggggactactaatgagtttcttatctttagagaatattttagtgatatttcaggtagtttaaaaaattgagtttgaaaagctccatcaagtgtactaaagttgatatttctgtaagttggagaaatttttaaagccttttgaaagtatcaaacatatttaaatttatttaagagcatttgacaatgttctaataagttttggatcttaaatatatgaaaaattgggttagaacaaaataagatgacccaactaggtcatccccttccattgagtagccggtacgttctatttttggcttgtagcacgtagtgggatgacctatgggatgacctctgagatcctgagaccaaaatagagagtctatttttcagactggccaaatgaggcgacccatgggatttctcaatcacagtgggacgacccatgggatgtcccattctgggtgaacctcgtaatgattagttttcagtttatttttggtacatttaatgcgcattaaatacactccaacggctcttaactgatactaaaatactcttaagtccaaatagaggctataaatactctctagaggtggaacatcaatcaagattcatgcattgaagctcacattcgtgaaagtgaaagaaattcctaaaaagagaggaaagaagtaatcaatcagctcaccaaccactctccagctgtattcaagtgtgccaatcatttgagggtgtttagcaaaagcttcttctccttaagtattatatttttattgcatttattatgctcatttaagggactgttgtgctgaaatttttgtacactatccatttgctattgtattttggattttgagttttgggagttttcaaaacttggataggttgatccgaatctgaaatcagagtgtatgtgggttggcttatacccaaaaaataagtattcttgcttggatagcaagggtcgatgttattcgatgttttgtatcttgtaatccttttagtggattgaattctcaagtaggaatttggagagtggatgtcggtgcaaggttggcatcgaactactataaatctcttatgtttgttatgcttgtatatcttctttcattcattgtgctttatacgtgtttacttatcatttatagttgatcttattttcttagctaatcaattcaccccactcaataagtatagcacattacttaagagaactaatcataaaaattttaaaatgaccgaattcacccccccctcttgtgctccatatctgggcaacaagtggtatcagagtccaatgctctagtccttgcttgatttaaccatcaagagtcaaagatctatgacagtctaatttagtacatctctagctgagagacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattggtaacattggtatcactctctccacttgtattgaaaatatgttacttgtagatggtctcaagcataatcttttaagcattagtcaattatgtgataaaagttacaaaatagtttttgaatcatctatgtgcattgtaactagtctttttgatgatagcactagattaattgggcataggcatggcaatgtttacatggttgatttgaataattttttcatgcaaaacatgcaatattttatagccatgaatgctaaaatcaatgagactagttgactttggcaccataggcttgcacatattagtacgcacacactatctaaaattattaaaaaagatttaatttttgatttgtcaaagataaattttgataaagacaaaatttgtgatgcatgttaattaggtaaataaacaagagtttcttttaaatctaaaaatattgtttcaatttctaaacttttagaatttttatatatagatttatttgatcctacaaggacaactagtctaggaggtaaaagatatgattttgtaattattgataacttttcgcatttcacttgggtcttgtttttagcatctaaagataaagcattttcagtattttttaagttttgccaattatttcaattcgtaatgaccatggcactgaatttgaaaataaagattttgaaaaattttgtgatgaaaaagatatagatcataatttttcagcacctagaatatcacaacaaaatggagtagtagagagaaaaaataagatcgttgaagaaatggtccgtatcatgctatgttagagcaagctcccaaaatatttttggacagaagtaatcaacacagtatgttatattttaaaccatactttaataagatcaattttaaagaaaacaccatatgaattatggaaaggtaaaaaatctaacataggatattttcatatttttggttgtcgttgctttattttaaataatgacaaagatagcttagataaatttaatgtcaaatctgatgaagctatccttcttgactattctacttctagcaaagcttttagaatttttaataaaagaatactagttgtggaagagtcaattcatataatttttgatgaagctaatgatcttccatcaaagaagagagaggatgctgatgatgtaggtattatagaagaaggaatgaaagagctcaccatcaatgactcaaatgagcgaaataaagaacagttgaaagaaaaatatgaggatgagagcatcaatgatcaaatcatttaagaacaacctcaagatacaagtaatcttccaaaggaatgaaggtatttccataatcatctcaaaaaactaatcattggtgatctggcacaagggataagaattcgatcctctcttaaagatgtatgtaattatgtagcttttatttcacacctagaacctaaaacaatagatgaagctgaacaggactataactagataattgctatgcaagaagagttaaatcagtttgaaaaaaataatgtatggactcttgttactagaactaaaaatcatccaataatcagaataaaatgagtatatagaaataaattagatgaagatggtaatataatcaaaaataaagcaagattagttgttaaaagatataatcaataggaagaaattgattttgatgaaatatttgcacctgttgctagactagaagccataagaatattgcttgcttatgcatatttcatgaattttaaattatttcaaatgaatgttaaaaatatttttctaaatgattatattgctgaagaagtatatgtagagcaaccctcagactttaaaaatcaaaaatatccagatcatgtatttaagttaaataaaatattgtatggtttaaaacaagcctctagggcttggtgtgaaagattaagtaagtttttactagaaaataatttttcaggaggaaaagtagatgcaactctttttataaaaaaaaagatgaaaaaattttagttatacaaatatatattgatgatattatatttggatctactaatgaagtcttgtgccgagaatttgcccagctcatgcagggagagttcgagatgagcatgatgggagaacttatttttttttcggactccagatcaagcaaatgaaggaagagatctccatcatccaaagtaagtatacaagagaactattaaaaaaatttagaatggagagctccaaaagtgtaagtactcctatgatccctttctgcaaattagataaagatgaatatggcaagaatgttgattcaaagctttatagaggcataatagtctctttgttatatcttactatcagtagacctgatataatgttcagtgcatgtatatgtgctagatttcagtcaaatcctaaagaatctcacttaaatgctgttaaaaaatttttcaaatacttaaaggaacataaaatctaagattttgattttctaagcaatcttttgttgatttaatagattattcagatgcagattttactggatgtaggttagatagaaaaagtactaatgaaacttgttaatttttaagagttaacttaattttttggtttagcaaaaagtaaaattcgatggcattgtctacgatcgaggctgagtacattgcaatcgaaagttgctgtgctcaaattttatggattaagcaatagctcatagattttagaattgaactaaaaaatattcctataagatgtgataacactagtgccattaatttgatcaaaaattcaatccaacactctaggacaaaatatattgaaattagacatcactttataagagaatatattcaaaataataatatagtacttgaatacataaatactgaaaagtaattagctgatattttcatcaaaatattaagtgaaaatagattttatgaaattagaagagaattggacatcttagatccttccatttgatctctcattataattttactctcaaaatctatccaaaatcttttaacttcatcatcttaattttgagagatatctatctttttttaagattattttaagtcaatttaaagatcatcaatattattcagatatgatctcagattttttttctattgaaattcttcatcaaaaattataccaaaatttatctgaactctacatgatcatctcaagtcgatgcaagtcttttcaaattttttcttttgatttttttctcattttgaattattcttttattgcctgatttttctgtagatgggacgacccatacggcgtcccaattgttcgggcaaatggattttgtgtgagccgatccgtttaaattccttgcttaaaacccaaatgggccgactcatttactattcttcttcctcctctcctcatcccaaaccaaaaccctactccaagctccccgccgaccacattctcttaaatccaaaccttaatccgcctaaaaatctcttgtttctaccttaaaatctagggtaaacacatcctctcgacatatctttgatcaaaaccctctccttcttgctctctattaaaactttaagccctaatctccaaaatctgagacaatcacctcaaaatcccttctcttcatttccatccatccttcaccctcctctattctcttgactggttctcttgctctcattgggacaatagcccccaagatgcggttgccatagagaaagaagttagtgaggtctttggaggcagaagaaagaaggaagaagactgctcaagtttcagttcaagcctctcctcccataatttcaagtaagatccctctgtctgcaagaaaggttgccttgggaagaaatattgattttcgattcttgagaagtgatagatttacaattgatgcaaaattaatcaaacaaaggtggagatttttttgtagtctgtctgagcctgtatacattgacctgattaaggagttttattcaaatctagtattcattgatagggttctaagattagttgtaaagggtattgaaattatctaaatgctgctaggttgggtaggttacttcaaatgccctgtgaaggaagttgcctcgataagcttccaaagaaagagatcaggctcaggatcattttaggaagagaggatgtggagcggttcataaaaattgaggttaaagatttcagtgtggagatgagattgctccaccacatgatttctagaattttcttctccagagggggtagaaatgatttgatggctgatcgagatatctgtttgatgcactatagtctctgaatctccactaatttgtcattcttgatgattgatgccataagggaggtcttgaatagatccaaggctcccttgctctatggtatggctcttacagtgatatttagggagtctggagtgagctttgagggagaggttgtttgcagattaatgaacactgacacctacaatgaccactcccttcgacgcatgggatttatcagagtgaatgttcgttggaccaaggggcgaggagctgcagtcgaggaggaggaggaggagcgtgctcagggggagggtccctcatcaccacctaagcccaggtagagctctgatgttcattttgtataggagcctgaggcaggaccctcagttagtgcatctccgtctacgagccatgccgtgccgtgccatcatcacttagattgggagaggatgagatgggattgttagctgagcgagtagtaggtattctctccatccaacagtagcagttccagaagtaggtccttcaacggcttcagtattatcagcagcagatcctccagcaggtgcagcagcagcagtatcatccacctcagtcgagttcttttctgtctcttcctcagatctttcagtcgtgccacatattttctcactgatacagcttttgtttgacctgagctccagactggagagtgtagagagctccatactcaggtttagtggcaggatctttgatattgagagggagatcagactgatactagattcactgtcagcaggagcaagcacttcgagcagctcttcaccttagttagctgatctagcttgagagattgagagactccatagcctgcttcgatcgacacttgagctaatctagattgatatcaaagactcgagggactttattttttctgatcttgaggggctcagaattttagtgagaggagtcctgtcccaactagatgccattaggactcagctcgagtctaaaccctccgtatccagtgagcctacttttgttcagcctatcgcctttcgtcctccgacatcttctactcgaaccagaccatccagtcgaagtcgaggctgattttatttcaattattttgatcttgagcttgatgcccatgctccttgatctgatcattttgtattaccagttttaggttacatactacttagttgttatattttattttagtagttgaatgtatgagagccttatgctcatagatatatattatgacttgatcattgtaatgaatgaatgtacatgactcttgtaacctcttattttattataattaatgtatgagattatctattatcattactttatatggccaacctctgtttatatgtgaatgaaggaatgtctattacatttaaaattactttgatacctgatgtaccatcatagctcattaaaaatcttactctctctagtctatttttgatgatatcaaaaagaaggagaaggtagcccatcttgaatttttatgaatttttttgaattttgctctgatacgttcattttttactctgatacgtctatctttacttctattttaatatttttataaaatactctgatacatctattttttattcttgttctgatactttcatctttgccttaatatcaaaatactctgatatatctatttttgattttataaaatattctgatatatctatttttgattcttgctctgatactttcatctttgctttgataccaaaataaggaagagagaaagaaagatcctatatctatttttgattcttgctctgatactttcatctttgctttgataccaaaataaggaagagagaaagaaagattctacatctatttttgattcttgctctgatacttttatctttgctttgataccaaaataagaaagagaaaaaggaagattctttttatatacatattgctctgatactaaaaataaggaagaaattttttttttatgaactatttttgctctaataacaaatataagaaaaatttttacaacttgaccactttttatataagaaagagagagaattttttttaaatagttaaaatggttactttcattttttttatataagaaaagagagaattttactgattagaaataatttttgaaaaattctaatactttcgcaaataatttttagtaaaatgatttaaaatattataacttactaaaaatatgtatctcatgatattctatacttaatctttggtatgtttctataagtgcttcacaaactcaatctcttgaactttatggatcttttttatgaacacttaaatattttatcattatcaaaaaggaaaagattattgcttcaagaattaattttgatgatcacaaatcatttgaggtgactattaatgagtttattatctttaaaaaatattttaatgatatttcagatagtccaaagtattaagtttgaagagctccatcaagtatgtcaaagttgatgtttctgtaagttggagatgtttttgaaatcttttgaaagtgtcaaacatatttaaatttatttaagagtatttggcagtgtttcagtaagttttagatcttaaatatatgaaaaatcagattagaataaaatgggacgatccaactggatcatctccttccattggatagccggcacactctgtttttagcttgtggcacgcagtgggatgacccctgagatcaaaatagagagtctgtttttcagactggccaaatgagatgatccatgaaacttctcagtcgtagtgggatgacccatgggatgtcccattctgggcgaacctcgtaacaactagtttttagtccatttttgatgtatttaatgcgcattaaacacacttcaatgactcttaactgatactaagacactcttaagtccaaatgaaggctataaatactctctagaggtaaaaaatcaatcaagattcatgcattcaagcttacattcatgaaaatgaaagaaatccctaaaaagagaagaaagaagcaatcaatcagctcaccaatcactctccagctgcattcaaatgtgccaatcatttgaggatgttcagtaaaagcttcttctcctttagcattatatttttattgcatttattatgctcatttaagggactgttgtgctaaaatttctgtacactattcacttgctattgtattttggattttgagtttcgaaggattccaaaactcagataggttgatttgaatatgaaatcggagtgtatgcgggttggcttgtatctgaaaaataaatattcttgattggatagcaagggtcggtgttattcaacattttgtatcttgtaattcttttagtggattgaattctcaagtagagacttgaagagtggatgtaggtgtaaggatggcatcgaaccactataaattttttgtatttattgtgcttgcatatcttctttcattcattgtgctctatacttgtttacttgtcatttgtggttgatcttactttcttagctaatcaattcaccccactcaacaagtatagcacattacttgagagcactaatcacaaaaattttaaaaagacccaattcacccccctcttgggctccatatctgggtaacaagaataaatcttgagttcttctcaagtacttaagattgttcttcatagctatctagtgctcttcatctggattcgactgatacttgctcgcgatactcatagtaagggcaatatcaagtcgagtatacagcatagcatatatgaggctctctatcattgagacataagaaatcctactcatacattgaattttttcagatatagtcagacatatcttcttgaaaagatgaataccaagcctaagaggtagaagtcctcttttagagtttttcatgtcgaacctcttcaatactttctctatgtacagctttcgtgacaagcctagtattttcttaaatctatccctatagacttttatttcaataatataggatgcttcttctagatctttcataaaaaattttttggacaaccatcttttgatcgaggtcagtatgaaaatataattttcaataagaaagatatcatccacgtacagtatgaaaaatgttactgtactcccaccgatccttttgtatacataggattcctcctcatttttgatgaaaccaaatgatttgatcgcatcatcaaaatgaaggttctaactccaaaaaatttgctttaatccgtatatgaatctttgcagcttgcagactctatgatctctatcatcgaaagtaaaatctaaaagttgcttcatatatatatcttccttaagatatccatttaagaaagtaatttttatatccatctatcagatttcataattataatgtgctacaacaacaagcaaaggacgaatagatttcagcatggctacagataaaaagatatactaataatcaatactttcatattgactataattttttaccacaagcctagctttatagatctctaccttactatctgtacctatttttttttatagatccatttacacccaatggatactatactctttggtggatccactaaggtccatacttagttcgagtgcatcgagataatttttgacttcattgcatctaatcgtttctcaaaatcgatgtccgatattgcctcgtcaaaggtattttggatcatctccatgacccttatctcccataaggaatatttttttaacatcctctgtaaacatacctatatacctttcaggaagataggagatcctactagatctatgaggtggtagagaaaaattaactactagttcattaattatggatttttaaggatctatagctcattgctgtttagagatcttctcttcgagctcaattaacctccgattgctactatcctggataaactatttttttaaaaatatagtataatgactcacaatcatattgttatcatatggaaagtaaaagtagtatcctatggattcattcggatacctcataaagtgagctatggcagatctatcctctaatttatcagtcatctgtcttttcatataggctggatatccataaattttcagacgacctagactcggcttcttaccatgtcatattttatatggtgtggtaggaacaaatttagtaagaatcttatttaataaatatattatagttaataaagtatatctccaaagatataaggataaatcatagcttttgctggcaaatagctaaagccaaaaaaaaaactttgaagcagtgccaaacagggcatggtaagttggtagagaaagtttttgtgcaagcgcatcacccaataatattgagatacatagcgtactttgatggaatagatatttaataccgctcaatttttttttcttaatttttagcaatgaaaatattttttttgatataataaataaagaacaatattattactttctcatatcttgtatgacttctagtgaatatatatatatgatatcctaaattatagatatgactttatatatctttataatattctgaataatatatataactttctaataacttgtatgactttttgtgaatatatatgatatcccaaacaatatatataacttctttatgaatatatatatgacgtcctaaataatatatactgtttcctaatgccttatatgactacttgcatatatatacgacatccagaataatatatatgacttcctgtaaatatatatgatattttgaataatatatatggcttcctaatatcttatatgactttctatgaatatatatgacattcagaataatatatacgacgttctgaaccatatatataactttctatattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatatatatatatatatatatataaaattatatattcatatatatttataaaaaattatataaaatatcaaaaaataataatattattttttttattttataaaaaaaatgatattatctcatttaaatgtgctgcgtgcccttttattaagcggttgcaccgcatgcggtgacataacgggctttcgctacttcgataagaggcagttgtttttcccagcaccagcattttcccgcttgtgcttcggatattcgccgccaaaccctaaacccaaaaaaccctaagcctctttttcgcacaaagatggggcgcaagaggaaatttatcgacaagaagaactccgccatctttcagcttcttgcccgcgattcctcctcctatcccgccacctccgccgccgacgatggcggcgcaccggcgtccgaccgcgtcttcgtgcgggtcgacaacaatccctactccgtccacggcctcctcgacgaggaggattgcagcgatggcgacggcaaggaggtcctccccgaggtcgatgatgccaattccatcttcgccgatgcgccaggcgacaccgatgacgatgggagcgccccgccgccatggattggcgccgtcggcggcgcatcccggggtcgcaacgggaacgcccttccagaccacgtgaggcgggagattttggagctggggctccccgacgatggttataattacctcatccatctccgtgagatcaagaatgccggcggtgggtcctcctactaccataacagcaaggccaggttcgattgggttccgctcgatgttaaggtatttgttcttccagtttgattggttgattgattgactgcctggaactggcaacttggttccttttcctgatatttttttccccatcaatttaataggcctacgacgcttcaaggcttcgaattagctctgcggtcggtgatgagtcgaatggggattcaatctatactgttgcttcgaagactgttggtgttaaggttcagaaggcagtggatcctgatgtggcgaagttgctggatgatgatgatctgtcacagtttggatcggatgttgaggatttggaggaggatttcgtggtcaaggcaaatcttcctgaaggagaggacgaaataaatgaggaggaggaggaggaggaggagggaggtggtgagaaggttgctgccaaagaagaggttggcatggcaagagatagccggtgggcagagcaggagaatgaatttgctcagggaaatggagaagatgaacttaagggtggtgaaaagccaagagttcgtcgacttctggatgagcaatttgatcttgtgagtttctgtgttttattcactattcccttttatatcatactggcttgtcctgtgatccacatatttttagaaaaaatgcaaagaattaaacagtatgctgtaatgatgtgtggaagtttttagatacatcgtagaacatataccatacccatgaataacaattcttgctttagctatttgtcagcatttaagtgcttagctattcatctgatagttatgtgaacaaacacatgcacacaaactgaccaacaactgaacatgactgcatcttctgtcaggcatattgataaccaatgtgtgttatagcattattaaggtctttagggctagcagagtctaacaattcgtgccttaaagacaatattcttttttcattgaacatcttcatcgatttagagcatacttgttatcatggaggaaagttatatgtaacttgccagtttcttctagttaacacgtaggaaggacccattgaatagtgaagtcattcaaattagagatatgcctccataaaagctatacaggttaacttgtattagattacttagctcattgtcggaacatacctgtcattattggaggaaaattgtatctaacttaccaatttcttatagtgggctaaacatgatttcaatgatcatgtagtcgctgttaactttgacttttatgatgtggctctgcacttttctgttgttaacatttgtattatttgtattttgtatggagaaacctcgtaaaacttcagaatttttagcccatcaatttgtcaatttggacatgaagtttgaacaaaagttcttgtaagtcatcccaagtctcttatttttagaaagcattaaggtacaggcatgtttgttattgtaaggcttatagttgcttgtatcccactagcttagaaggtcatgcttccttttgaaaaactaaaagcaaatatagtttgagaataattaaaccaaataaagtgagagacccttacaatcactggagatggatcaatggagttgttcatctctaaggttgaactagattatgtatttttatcctagcaaaacaattgcttgcctcaattatgcctcttcaaaaagtaagcctatgacaaaacaaaacatggatggagctctcctctagctcctttaattacaatgttatggaggtgatatttgtatatttttggagcttagactgtaaattgaatgaatgagttagaaagctattctaacattacttaaacactctctcaatgtttctacacactaaatgttttaactgttacactcttttactcttggggtcatgtttgactggaacaagtggagtcatgataatgccggcattaaatagaaagcggctatgacttctggatttattataaccaccacccaacacattcaagaataaattcataacttgatctgccatttatgtgacaaacgacctgtcactttgtccttttaatcccagtgacacaaatgttatttcaaattatcaataattgtacatattggcaagcaatcatactatacgcacatgtgcaacacataacccattttggcttttaggtcagaagtcaggtggcacttttagccaatttaattcgaacttactgatatttctgctagggcaaccctcgggtttatcctggatggattttatttcaggtttggttcgataaaaccccattgagacactgaattctggtgatcactatgacctcttgtattgtgggattatcaaactatgacatcaaataatgagcataatccattaaacagacgaacaggtgaaagatgtagatgtagagacatatagaaacaaaaaaaaaaatattgaccacataacattaagctgtaggattaagtaacatataatgaagtaaaccaaaaaatttgagaacatgatgttccattattaaacaaatattgctatatataggagtttgcattgattttggcgagcccaagaatcgaaccagaccaatcttgttgggctggtttggttcacattttagataagtttgggtcattgcagttttgattcttcaaaataaagcaattagattaggcacggtctgggttaagaggttaggtaacccgacctgacttgacccaatccatacacacacatatacacttgggttggagtttgtgatattagagatcttcattcattatcattagcttataactttatatcttctgtgtcttgttagtttgtagttgttgatctttttgttagttttactaaacatcttcaatgatagcttcttttttatattcattgagtctcgaggaattatattattcctaaataaactcaataatttatgtttttaagaaagggataacccgagaagtgtccgaactgaccagatcttgatttggttgggctatgacatttattgattcagttctggttccaaaagacgagaattgattgagatcagattgattctaggttggcctctaaccctaaccaccctgaccaatgtgcacccctggttattagtcctgatggttatagttaattagttattgttatgatttagtgcccttaactcgcttgtaagtttttattggtagtagttaactgttaatgtctacatatatagttgcttgcttgcatatgcaacatgcttcaagaactattaataggcattttctggtttttaacatcttctattttactgaatgtggtgatggtaactatgggtggtgagttgttatggttgagatcttccattattgcatgttgtggtatctaataatctgacatttagcatatataaaattgaaattggtgatggttgttggcataatctgacatgaatatatgtatcatcatcctggtgaatgaaacaagtactaaataatgtgaaatcaacattggtgtagtattagtagttccatatttcaccaacatattgtcatggaatttcaagattgaggcatgtttgctatattttagcactttgctgtttcgagggtctattctttaatttacaagattgcagatgttgcatttcattaagtaaattccctataaacctgtgatctctcccatatcttacagtcacgtatattttctcttttgttacagctcacactgcgagaatacgataatgacagtgaagatgatgatgctgtttatgtagatactgaacgtgaattgcttgctagtaagattaaaaatgtccttaaagagtatgcaatggatgatttggaacttgatgacaagtatagggtgccaggggtttatgtacatggtcatcaagtgccaagcacagagacacagctggatgcatctgctgatattatccgcaggtgtgcacagtttgctgaacagtactgtaatgagagccaagatgatgaagagattgtggttgaggaaagtagtgaagaatctgaagtatgggactgtgagactattgtttctacatattccaatctggacaatcaccctggaaaaatacaggctcctgagaatcctaaaaagcgtattccaaaaaattttcctggagacttagttgccaagagcaatgtgattgcacttcgaggaaaagaaaagcttccggtggagtacttaccacaaaagaaaaaaacaggtgaaaatttaaaaacaacagtaaaatcagatgctgacaagccaaagaggagacaacgtggggaatcaaaggaggacaagaaagagcgcaaggtaactccaatcaagtagttttcatgtgcttgttgacaatttgtttgcaaaaagaaatagaattgaatggaaatggtcattttttcaaatatcttgttttcctcagcgctggtgagcacctctctccttagtccttgcactggggctgggttctgagtttgacttggaataaaggcattcccaccatattctgaaaaaaaaaattgtcttgtttcatgagatatcaaattttaattttaggttttattttcagaaactattcttgctattaatatttcatggcacataagttattaatttctagaacttaatgactttctatatggtaattaattgttcatggagcaagataattaaggatatttggaattggataattagcttcaacgttgatgccatgaactaagctataaaagtcatgtattgttcattttgggtttgatttttctagaactttgctgatatttatcatcgttgcgagagaattgaaggcttcaattgttcagaacattttctcagcatgaatttatcttgtttaactgcatgtctgcaactgcttagctgttctcataataagacgtacatctgcattttttatcccttctaatattatctctttaaggaaacctaatatttgggacaacacttggtagttatgatggttatggaatttcttttttaggtgtgcttttatgctagataattatgatttattgtgccttagaatgtcaggattgttgtaatattgttgtacatagaacttgtggagcttatgtaaattctgtggctgtaataagcaggctgccgtaaaagaagagaaaagagaagcacgaagagcaaagaaagaactgaaaggcctgtacagatgtgaaacccagagagctcagcaggttgctgctgtttcagggccatcttccatgcaccttatgtaagccaatccgcatttgttgcttctgctaacaataccacctctaaattaaatgaaaatattccatcatttccccacttattttgtccaagccaaatgacaatttacttctcaattctttgtaaatccttctaagatagtcctgtcttctgttcccaatatatgttggcacttaaagtttttttttaaataaatatcatagattgattaaattttgtagtagtttctcattcacttgcattttaaaattctctcctctacaatttgatcttgctcagtggctaccttagtttttcttttcttttctttcatctttcttttcttctttcagttgttggtcttgacatctcaccacatttagtagaaaaaatttatgctgggggctagaaattgttaacatgactagatttgctattctagttgaaattgtaagagtttgttgaagtgtctttgcatgctttctagcttctgatatatatgtatattatgtatgtatttgatggttcttttggcataggaagcatgtgagaagtgtatatcctgccacttttttctgcatgttgattgaaattctcattacttgtcaaaatacgtgttgacattttttagttcttataaatgccagattattttacaaattttaatataataaagaaaatttaaaatctaatatcttttttaacaaaggtagtaaggtgaatcatatactttgcttcaccagtagcccaaggacttagttaatgcattgccacatgacatgtcaaatctaaaatttttatttcatggacttggttaattagtatagcaataagctagttgcttgactatttccttggagatgtcaccaggtagtaacaacactccaggcattagaataccattgattgttgctcaatgattttcattgttgaccagatacaagtacccctgtggtcgattgagcttaggcatattattgagcttcgttagttacagccaatggctgattttaggatactagctaagatatcaggcagcacattattatgctggctattacatatttggtccaaaacagaataaatggagagcaacattagcttgaatatggttggattcaggggattgactagaattaagggatgaggagttctttcaacaagttcatatttataaaatggagtttgatgcctcatgcaggtctaagttaatgtagactagctattgacttgtttgtatggtgcatgtaaacacaaattgtgattgaaattaaagaagaacagtttaggaaaatattcttaagactttggaggatgtcagaaaagccaattagacaaacttggtgaaatgtcttaggtggctgtaccggcaatccttgaatttcattttgaaaagagatatgataatagagtattcattcttttgaactttgaagctatatttccattgttatagaagtgctcaacaaagtcatatcaagcatttgaactgcaaaccaagatacaatcatgataatcctcccaaggagttaaaacaccatctatcaatcttagagtgtcagcttgcaggcaaaactcatcctttcatggatgtaaaaatgttaatataaccagtctaagggatgaaattaaatagtaatttttgcttaatgaatcaaagagtaccattcatccctaagtcatatctagattacaaaacataaaactatataccaaccaacccatgttcttctaactgttaaatcaagctcattttcccttcactatcacatagacctagaataggctgtgaagaagagaaccagtagctaaatgaggatttgggaggaaaaaaatataatatgaagtaaatatactaaaatagtgtaatttatagacaataaaatatttatcatgcaaaaaactgaagatgaataatgccctcttctgctatatacaacttttgtcaattgtaaatgaaaattattgtggataaatgaactatctttatagcaataaatgatgactatctatttcgttcccaaattccaattaaaatgctagcaaaattctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctctctctctctctctctctctctctctctctctctcgtatattgaacaccagcctcacctagcagtaaggtggtgtggctagcggggaagatacatgcggtagaatctgatggtgcagtggtctatgctagaaatcagctattaacaaacaatactgaaggtaaagagggacatttttgcaaatcttgaggtagaagaaaaaggggaagtttgattttggcacttaggctcagtgttcagctcttgaggggttatggttgacagttaggtctttgatggaaattgacaatcagggtattgattgcgaatgagaagtgataaaataaggaatcagggattagttgagaatgagaagtgagatagaagacaaggggactgatgcatcaggttggagaatgagaacttggattcataaaacttgtcaggtatctgggttcaaacctggacatgcatctcaaatctggtttggatttatatctggggaactttaagacttgtcaaaatgcagtcatccataaatttgtacatctgaatggcacctaattcgaatatagaaacatattcggtcagaatttatccaacccagtttctactctgaaaagcaattatgatgcatgtattccaccagttatttaaagcaactaaattgcgcttatatttgcaaatgatttagagtgaaaaggcattaggggtgaatgtaatgccagttgaggcaaagaatattgtgagtgtagttggtcataacttattaaacaaggaaaagtgctaatcaaggtaaaatacaagcttgcagcaaccattttggtatttaatttaaatgccacaattagaagttgtgtaaatggttggaagaatgctttaagaaagctaacgacaatcctctacgatattttacttgatgtcaatcaaggaaggtggaatcgtcctgaactatccggtttggagtgtatcaagccatattggcggtggatcgagatagttccagcaatgaaattgagaaactggcaagggagggggagagggagaaggaaaaagaggaaggggggagggaagggagggagggatggagggagagagagggcagcgcgataagcagcagttgaagccctctctcctccatgcatcgaaatagggcagagcctctaattcaaaaagaaatgtgggcttcaaccccttctttaatttttttttggattttttgtgtacataccctcctaaattgtaatttgtatgaatacccttgcaaaactgatatttgcatgtataaaatacttattttgcacatagacccttttttttttcttttttcttttttccttaatgggtaggaatgcaaaaaaaaaaatttataagggtatacatgcaaatagtagctttgcgagggtattcaacaattttacatatttaggaggatttatatgcaaaaaaaaataattttatttttatctatttcaacttgtttaaatgcctagattatactcatactcacttctatttcaacattgctcatgaaaaaagatagattcaatgattagataacaaagagaggttttgaaatttctttcaccagttatgagtttattctactttattcttttttatttataataatcattctatcttatttcatcgaaaatcagcttgtaatatttattattatatatgcatataagagggtatatattagtatatataatgggattaaaatctcttagaggcacatgatagattgcaatgatcaagcttctttgtgctcatggatgaaagaacaacatcaatcacccttgaacaaaatcattgaaggacttcagaatttttagactcactaacaacttccgtggctatgtaataggaggtcatggcttatgttggatattaccttaagtcaatcttctttggagcttcaattttttgaaactaatgataggttcacttttcaattcagcaatcaaagccaattcattataaagataagaggattgctagtatagatatttgagtcaaacaaaaaaaaatctagacctttcttgactagctaataaggaagattgtggctaggatgaagactcttagtagatcttttggtctgagcctaatcataggccatcattcatcattcactaggtcgtccaatttttctagctcaaagctcgtccgatctctccaacttggagctcgtcaaatctctctaactcggattttggctgcaagaagccctatattttgaggcacctttgattttttttataaattttataatggctcataaataacatctataattacgcatttgcaacaaggataaataaattcacgatcaatttgttcaaacaagtaaggtgcttgtttgagtttgaccaaagcttagcttagctctggcatggtcaagcaagctatgaaacgagcgaaaatctcttgagcctagtttctatttttttataccttaagctagctaacatgtgaaatcttgacatatgcaagaatgaacttagagaataaagcttgaatcgggcctatgaataaatttatttattttagggagaaagagagggtataaatctcttttcttgagcagtgttttcaccgaaaatattaaggagtgagtatgagaataatctaggtatttaaacaagttgagatagataaaaataaaataatttttttttgtatgtaaatgctcctaaatatgtgaaattgcatgaatacctttgcaaagctgctatttgcatatacacccttatatatatatatgtgtgtgtgtctttatatatatatattgtgtgtgtgtgtgtgtgtgtgtgtatacatgtgtgtgtgtatatatatgtgtgtatgtgtgtattgcatgcctactcattaagggttcagtcatttaaattagaaaccatttcttaacagctttagatggtgggggtatatatgcaggagaaaaggaaaaagaaaggtatacatgcaaaataagtgttttataaaggtatacatgcaaatattagttttcagagggtattcacgcaaattacagtatttaggaaggtaggtatgcaaaaaatcattttttgattttttgacgtcaattaatattgattgttggtagttgagactatttccttgctaacataattggaagattcaatgtgcaccaaaatgattgcaacccttttgggaagcaaacaaagtatacattgatagatactatggtgcatatatactgagacatatgtacataaattgcatataaagcagcattgatgagtatcattagctatggcaaaacaatggagttctctatcgacatggtcttacttcactaactcatacttcttgttcatttgtcatatagatgaaatctctcatatcataggtgcattgctataaattggctagatgatagtgatgatgattgcatatgctgtattggaattattgatgtctggaattcgatgttttagtcattgtttgtaatgcatttctttaaatagaaaaaagcagtctaaattaattaaacagcaagttgatatcctatgttgatttttattattttctgcaaaggcagaaaagaatggtgagccaaaaacaaattcaaattcaatagtgcagaaattggtagatgcttttgggccgtaaattaatatgatcaatgcatgcccctgagaattgggcaagttctttttacatgtttcctaaaaccaaagccgggttgtctcagtttcagtgataaccaataaagattggacctggcttccaaattttgtccagcgctaacttatggagccaaatttgttacaaatatgtgctattttttgcttttctttcatacatttcaaatgtgggtaagcatttcaacttgtttaaactttgatcctggaagtttggagagttttgggagcatcgcaacattatattataaagaggtttagaaagtattaatcttttaagttaggtttctctaacctaaagttcaaatttcttaggcattttactttatcatttgtaagattgctatggtacaacaaaatgatatatcaaactgtgaacatgatttttttgttttacattacatttttaaaaatcatattttaattctatcattgtgacaaaagaaatgatatttacgaaggtctatgctatgaaatgatgcctaacttggtttttctcattcattagtttttctttagattttttgatttatcctagtgtgaatcaacaatttaacacatctttttttaataattttcatttgaaaatggagccaagagcaccaacacagtcaaaactgaaactcattatgtatggagtttttcatagtaaattctttgcaaggtttaccataccggtcggcactataccgaatatactgtaccatgctatattgatattgaactaatatgcagtcttatattgtaccgacattcgatacggcttgctggatcataccataatgtgtattggatgctgtaatatgatgatactggtataggttccatactaagagggcgaaccttaattctttgtgttgatgcaagagagttgggtctgatcacgtcctcactcctgtatttggctaggcttccacccatcctagtcatcaagaattttaaaagggagctcattatgattgagtcaaaaccaaagctaattctcaaacctcactataaattgatagatgtaacaactaataaatctcacaatgttgtattggacgggagtgcttggtgataaaagagggctatgtacataatcaaaatatggctaagagttttgaatttgttgtaaagatagggaaggttaaggagaggaattagtatgagaattgcactttttgtggataatatggtaaataaccagctttgatgtcacggccatgtgcaatgaagatttgagaacacaccaatggggaaaggctctcttcatcaacgagaattggggaagatgatattttatatagaaattgtgaaagtacttgatgaaattagcaaaggcagtgggtgtagccatgcattcactaaacaaagatgaaggcttatgaatccactataaataggtgatctaatgcttgttcattatacctatcattgcatcaatagctataccacattaatcagaatgtgggtggcagataaaagggataaggatgccaaggaagatactaaaggggtccagaaagattggcaggtataaatggaacagttagtaatttttttaatagaagagatcatttcgtatatttttgaacatctagtcaacttaggccaattgttattttttccatgtgagaagggatattataattcaggttcaggggactaatgaggatgcatgcttatcttgcaagcaaaaaaggttcaatagtctacctttttttttaatttatgccttatgtattctaatttatttatttccatttcactgatttatgatttatgttgggcctaaataaagactttgtcatatgttcttgtgtaatcaaagtttgaatataaatgaattacatagatgttactgattatctcctccttgcatatttatggtgttgatagtattagagtaaccgagcctgccttgactgttagttatggtgccctccatgacaggtaacacccagtttggttggctgtgagttattctttcatgacatgatcaagaaaagacccggaacaagtaaagctgtatggtctatggctacacttgcatgccaaacttaccatgtttgccgaagcaagcagcccaatgcatgatgcagtcaaaaggtttctacatatagctcttgggataaaatcaatcaatcagatatgcaatgtttgttctcttttggacctaaagcacaggttgttgagcttgttgtaatgccgtcagcagcactttctagcatactggggtggttgagttattattattattattttttttttctggtttatgtcatctagtttttatgaacccgataaatggaagctgctgtgtcctagtcttttccccagaacgaagctccaatctctggttcacagcattttgtttggttgctcgtgttcttaatgaaattatggaatgaacaggaatctatcgtaaggtctatcacgactggctggtgtaattaaaatcttcggctcggagacgattggtggtctcttgcaggtctgacttgatgaagaaatatggttgggggtgggggggagtgggcgcgtgggggaggtggtgttgggggtggggtgtggcggggaccggcatttgtttgcattgatagctgcagactgcagttgatagaaaagacacaggatggccggtttccccttctgctttacgatttatttaacacagtggagccccatcccgagaggactgattcgatcaatgcaagtgacaaatataagagcagttcgcggacagtgccatgctatcgaactcttgagatgcagcaggggagtattttagatatcgagtcattattgtggggtagggacgctcttcaatttttaaattatgtatgtcgtgatatatgtttgatgatgtgtcttgatccaacgataaagctgtttcattatgacctagaacatcatggattggaaacgcggatgcagactctccgtgtattgggtgaggtttcatctatcattatatccagcctttcgcaaatcctactatgacggaagctccacgcactgatttagcgtttgacatgtgaaagcagagatactccctttgaataatgaatccttgggatgcatgttcctttcatatagttacgtaactggtgaatggtggcgatattattcaataatgaatgggtttacgggaaaaaatcgtaagaccggacttcaggcgacgagcatgaagtgtcaagtgtgaatcttacggcaaaggaactatcgtatgtaggagctattggttttcgttattgtccaaagaggttgggattagaatgcaaactgcaagctgaaaagtttgcagggcaatgtgcatgcattgtcagggtcagcgggcggaggtagaagggcctccaactggaactaaattatataacgagatccaaccactctatactcatcttcaatatcttaactcatccacttccttaaaccaatgtaaagagcttgtaagacgataagacgcaggattccttctctgtgggaggaagcatgttgacgagttggatagggttgacccataaagctcgcttaggcttctagtggtgaaatcggtatccaaatatctgcttatgacccataaatatccgatgtgatctgtcaccagaacattttattctggaaaaattctccaacgcaagtcatacagattagaaagcacccgaaacccaaaaaataattaaaaaaaataatgaaacagtttttttttttttttttgaactattgacattaggaaaaccataagtaaagagacagaaggtggcccccaggttttgggtggtagtttttggcggatggtgtgaagtttgtgctgcactttacttggcagcagtgctacgctctttgcttttttcgacccgacgccgacacgaacagtgacatcaggactaccctcgcacggtaaaatatctatccacccactctttcctgtctcttaagtaacacctaacaataatatcactaacctaatatgactaaattaacctttcgaaagcacgagtagctaaacgatccaatcaagagagatggctgcggcatattctgattggggaccgtagcaacccaagagccagctagctgcgttgaaacgcctccacagtcatcatctctatctctaatcaaaattccgaggacatggtgcacttgcagccgcgcggttgtacatgtttggaacattagggaggttgcacctaggtcagccaattggccacgcctcgatcagccttaacggaaagattaagaagcattgttcaagaattattgctgtccgggtttatttatgctagagcttaagaagaatagatatcgacctataaacatgaaccgcggatgctaacatggaatttcagatcgagagcagttcgagccatgccctactactatgtagtcgcatgaattattgaagcatgagaaattgagtctggacacatgcaagtgatattggcgtgtgaatgtcaagtgggcttggaacacatgcaatcataggaaaactttttaaacgacagcctaactaccgtaccaaaaaaaactagtattgtcttttccacctagaaacctagtcgatagctactaatcaactaacaaagcaaaatcatttccatagataagaaaactaattaaacaaatctaaagcaatgaatcatccgggtaatcattttctgaacccatatcttctcctcatccgcaacagtccaagtaatttaatcagcttcctgcatgtcttaactcattaaataaacatacttcggtttctcctttctctatccatccattcgtcattctgtcttgcttcacagggctatatccatgcgcagattctcgcgtcacaccttccactcggaatcgaacgcaatccccctataaatacgagtcctctacccccttttccctcaactcctaccgcgctacaaaaagtcaaatcccccttccaagctaataataagcaagagagcaaattaaatgatgtcgaccaagtcctccctcctcgctctcctcgcccttctctttctcgttgcctcctctctcgccgctgatcccgacatgctccaagatctttgcgttgccgatctgaactccagtgattgccccctctctcgatcgacttgacattactcctgttctcttcaactcgttttatttattcatttatttaattggcttaattttaaagatgagaaagcaataattaattaattaagcatgcatgtcttggctattatattgcattgtagtactaataatgagatgcatcgattggtgatatacatctgtttgaccactactgcagctgtgaaggtgaacggatttgcatgcaaagccaacgtgagcgagggcgacttcttcttcaagggactggccaccccgggggccaccaacaatactctgggatccctggtgacgggggccaacgtggagaaaatcccggggctcaacaccctgggcgtctccatggcccgcatcgactacgcccccggcgggctcaaccctccccacacccacccccgcgccaccgagataatcttcgtcctctacggcaccctcgacgtcggcttcatcaccaccgccaacaagctcatcaccaagaacatcaccatgggcgaggtcttcgtcttcccccgggggctcgtacacttccagaagaacaacggccatgtcccagccgccgtcatcgccgccttcaacagccagctcccaggggtccaagccattgccgccaccctcttcactgcctctccgccggtgcccgatgttgtgcttgcccaggctttccagatcagcaccgaggaggtggagaagatcaaggctggcctagctccaaaaaattgatattaaacatatattagacatgagcttatggatacatgagcttatggatttcccatttggtttgtcgtgacaagtttcagacttcaaacttccgaattgttgtgttcctaactcatgatttatcatttctttggtgtcgttctgtaacgttgctttctttggtgttgttctgtaatgttgccttgtttcagagaggatgacggaataataattaaaataataggtctctctctctctctctgtatatgtttgtgtgtctatatattgctttctttggtgttgttctgtaatgttgccttgtttcagagaggatgacggaatctcaaacttctgccaatgctatcatgtctcccattctagaatcataattcgaggatacgaaagctgccatatactcataagagttaacttaatactagcttaaaatctcatgcgatgcacgacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggagagagaggagacaggagagagagagcgggagggggcggagagagggagagcaggaaaacaaacgaaagtgcatcatggactcattgcaatgatttttttcttaggagggctcgctggatagaggagggaggggagaagaaacttagagggaaaaattgtaaatttctccaactcctggggtgaggctcaaggtttcttcgttggtccccttcttactgaatctagcattaggtcttttctttctcctcttccacgtggtgtcgtttttttttagcctcctacctcaatgtccccgaactatggctttcctgtcgtcgttctcgacccatccgtggacctccttccacggctccatgctagtagcttctttcgttcccctatggagatgaagttctctcgctcgatcgtatttcgctgaggagatgggctcatgcactcccacacttttttcaaaacctcagcgctccaatgcggcttcctccgattttcttagatggacacatgacagacggaggcttttcaatatggaagctccattttaatatatatatattagatgtagggtgaaaagcaagctggccagtagggctaggccatgcccctacccaaattgacctggtcaaatattttttaggcttccaacctggcataggcttaaaaatatttggataatctaggcccgtgcctaactcaaactcggttgagctgacccaaattatccatttgggccaaattggattgaagtttaatatttcataaggttgcttcataagtaaattatctagctaataattggactttttcttataacacaaataaatgatatatgatatatcattctcaactaaactcattctaatttgtgctttacttcctcatcattctctccataaaacaacataagaaactgttatggacaagggctcgaccggcccgttatgtgaggtattgtccactctagcccgtagatctcatgattttgctctttaaagggcgtctcacgtgggaaggatgatcccctccttataagcatgagtctcctttcactcacaacctcagtcaaaggggactctgatgcgtactcctacagatagtgtttgtgtactcccatatatggattagtatatggggagaggagccccacagtccatgtaaagtggtgccctcctagtgtcattgttgcgatcaaggactcataacttagtatgtgagatattgtctgctttggcctttagccatcttgggtctttgggcctctatccatcttgggccttatgattttatcccttaaaaggcatcccatatgggaaggatggtcctctccttataaatacgagtctcctttgactcacaatcgatgtgggactattggtgccctctacattattaaaacaacaaacaaagcctttcagtcaagggagactttgatgtgtgcagttcgaggagtcccacagttagctaagacgtacctcaatcccaaagaaccaaggcatacctcggatcctacctggctcgtcattattatggacaagggttcggcctattatgtgaggtattgtttgctttggtaggagactccgcttgtgtataattcagtcaagacagacttcagctttagagaatcgaggcggaccttggctcctacctagcataccattattgtggacaagggcttggcccattacatgagatattgtccgctctggcccgtaggtctcatgattttgctctttaaaagatgcctcttatgggaaggatgatcctctccttataagtgtgagtcccctttgactcataatcgatgttggactattggtgctctcttcacaatagaaacaaatagatataggtttgaatttggactttgctccagttcttactcaagctcgagccaaggccaggtcaatgacatatttgagccttgcccaaaaaataaatggactttgcatttaagcttaaacctaatccgaactttttcgagcctagctcatagtcgaatatgaagttagcctaacccaatgagcctttggccaacccgatccccttttcggtcctacctataaaaatgcaaggcattccatctattagagaatccaacataactcggaattcataaaattcatatatatgtagtaatgattatcaaaacaactaaaatatcatataatcatgctcaccactatatgtcaaaaatatgtgtcttcttccaaaatttatatctcaaaatttttgtatttaagctattttatataatacccaaacaaccctttttttggtagaaccaaacaaccctttaacgtacatgaactgatgaagactagatctactaatcataaaatcaagctggcctctatatattctcccccaaaagttgatattagcttaattcttggttcttggatttagaaagatatagatgaaaattataagcttcacaagtcagtaaataataaatctattttataaaattggattaattaagccatattaagtaatttatcttatttaaattatacaacatatgatacatctgtacaagtagaataggattataatattttctttcaatactaaccgtatgttgaaacaatgtattccatccttttaataatatcaatatataatgaattcatatatcatattagaatcaaataaatattcggtctcataatcatactcacattcaaatacttgaatctcatgtataagtttcaaatctatttagctatatggcctagagtatagctacatacatccttatggtgtaggtcaacgaccatatttaaccactatgataaggattcttatccaaaatagtgatcacaagacccaattaacccctatagcgtaggttatatgatcacatttaacccttatggcgtaggtcacatgactacatgcactcttatggtgtgggtcacatggccacatttaacctatattgcatagatcatataatcatgtcctggtccatatagttaagcacaatcaaatgatacatatatatacatacataaatcatttttttttcttttcagtgctgcttatgagttttatatttgaacatataataatttcaactttacatgcttagtcatattatgataatttaattatgtagttacttatcagaactccaataataaattaaatttcatataattataaaatttcatatgcaactaatcttggaattatgatatcaatttacataattaatttataataattattagaaattgtaaatattactaattttgcggatgtctataacaatagcagaaaatggagaataaaagaaagaagggtagaagaaggtgcgataccctcccacccatttctacatgcaaagaggaaggagggaacgatggggaggagagagagagagaagggaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtgaggtcccctcattggtgttccgatcgacggcacggtcggcgtgaggcggccatcggcaggaggggagtgacccaacgatgagaagagggccaaaatcgatggtcggcggcgaccatcgacgtcggaaatcaacgaaaaacgagcaaaatatagaggttcttccgcaacaaaatccggcgactccaatcgccggcgagcatgcacactggcatggaaaggaagggggagaagagaggaaggggaggaggcttacctccgacaccggcgaggcttttccggcgagaaattggatagcacaaggacgggtctccatgaggaatttctggcgattgccgccgttgagcttgtgatctttggtggaagggagagaggagggatctcctccttaaatagaaccggagggagctcgtctccgactccgattgggagccggcgagaggaggaagaagactcccttcgggagtcttctcccctatttttctgtttttttttttgttcatttggattcttacatgggttgggccatcacaagtagagttgtgatgacgtggtagttgaggacatttgagacttatctggaaatcctgcaaaatagaacaattagaagcaaaggggaaaactatttcatcaaagacaacgtgtcatgagataaaaattttggaagtagatggatcaaaacacttatatgaatggtgttgagtggagtaaccaacaaagacacatggacggaaccttggttccaatttatttttgctatatggatgtaaccaggaaaaacaaagagaaccaaaaattctaaatttcaagtagttaggactctgattaaatagaatatgcataggactctttgaattcaatacagagccaagcaaacgattaataagataagtggcagtgagaaaaatatgtggccaaatgcttaaagaaacagaagcacgtgataggagagcaagtctagtttctacgatgtatctgtgtctccttttagtagttcctatgatttgaagagtatgtggaggtgaaacaaaatatgaaataccaagcttagcaaagaattgtttgactttaaagtattcacttcccctattagtgtaaatagaaaaattttagtcttgaaataattttcaactaaggcctggaatttaagaaacatagaaaagacttcacttttattttgcaagggatagagccatacatatttgctgaaatgatcaacaaaaataacataaaaatgataatttttagttgaagtaacagaaacaggatccaaacatcagagtacaataaatcaagaggacccctactttgtaacgttgacataccaaatagaagacgatgactcctaaacaactaacaaggctgatataatgacaatgactgacggtcagacactagaagaaaatattcctggacaatttgctgtaaaaccttggaagatggacgcccaagccatgcatgctagtttggaaaggtggttcattctccaactagtgtaagtggttttgaggtagtgacatgaaggtaggagggtagatagtagacacctcctttatttggcccgtgcaatagagtcgccccgtagtttgatccttaatcaaaaaatatgaaggatgaaattcaattagtgtattgtttgacttgcagaattgagaaacttatatgagatttttggcaagagaaggaacacaaagtaaattagccagaataaaagaagattttagagtattaagagcggtggagccaatatgtgtgattttcaaacctgaaccatcacctactatcacctcgtcaggatcatcatattcagagtgaatggctagattattgagatcaattgtaatgtgatgagaggcaccaaaatctagcaaccaatgcttagatgaaccttcagaagtagcataattgaccatgggatgctgcatgagttgaggacagtactttgtaatgtgaccaattaaatcacagtaccggtatttgggtgggggttgactaaagtgattatcaaaattattgttagtgttgttttttctcccatgattgttgttttgattgctgtattgcctacggttctgataattattggagtttccaaaattgtttgagtagcctgagttgttggagtgtccatctctattatttttttccttcctgtaagagttcccgttagaacattggcatgttttctgagtatagtttgcagtagcaacaacaattttagataaggattcctccctcttcaaatgttctccatgtgcaactaatttatcatgcaactcttcaaaggacaatggattatcgcgtgtgaatggaagcggtaatctctttaaaatccgaatgaagtctattaaggacatacagggtgatatcttcaagtgataatgatctgtcaatgattgccagttcgtcagcaatgatttggtggagaaaagataatctgtcatagatttggagccacgagtcatgttttgaaggcactcctcaaggctcataatgcgggagcgtgagtaattggcataaagattagccaaggttgtccaagcttcctataagatctcagctgaggagacaagaggcaccacatatttagagacggatgtgatgattgcatgttgaagtattgatcttggtgaatctatagagtaaacatcaggtttgagaaggttttgtcaccttcagtgatagttttgaaaggtttggcaacacttccatctatataacctagcaaaccatatctaacgagtaagaacatgaactgagcatgccaggaagaatagttgcttgctgtgagtttgagcgtgactgagctgctgcatttatagctatgagctgagatgagtttgactcaagatttggggaggaagaaatcacaacaggtgaagcagagtctgagcttgacactctcttttgaattagaagctctgatgccaagtaaaaacttaacagaagttttatgaaaagagcttcaccctatttcattgataatttctgtcatatatacagagatacatgagctaataagttacaaggaaagtttgaaaaataaattagagataataagatacaagtgagttgttacataaacaagaagttgtcgatacaattaaatttaaattcaaaactatttaattgattctctaacagtagagctgcgatgatgtgggtcagttatgataagattatctttaataatcatcacatcaatccctacttgccaagtaaaggaatggtagtcgttattattacacatatatagcgcaactctccctttgaaaacaatgattgtaagatcttaaatcacattgctatcaaaaaattaaactaggtctaatacaaataaaactagctagctagtacatagttacgaaagcaaaaatgtaggaagaagcttcctaagttattatttttgtaaactattttcagattttaacgaaaaaccttgattgaaaaggcacatgattatatagatataagaggaatatcatgaagctcgaggaagatgtttgggtcaaagataaccaaattattatccatacggaaggatgggagggtcaactgtatcaaactcaaaacacggacaaaggaaataatagaggagtgcctctatttttggacgcttaataggcaaatctatcagatagctaatttcttttagatgcacaatggagggcctatctataggtaatgatgattctcgatctaaagctgctactagtactatgaaaaaaattcaatgttcaatccttgtgattgtgtatctttcaacaatttaactcatgttatcattcaaatcatcaagaaattcagcgaaaggccatcctatacaatggatgcttggcaaacaaccataaattgttacaatggcatataagtagattgtcattgtatatgaatatgtaaaaaaatgtatctactaataaagagaaattaagatttggattccatattctttggttcattagaggcaaggtttcttcttcacggtcccttttttttggaatgcaagaaatgaccccataaaactttcttgggagattgcatagatattgaataataataataaaataacaaaccttgattctatactctttaactttttattaggaaaaaaatagaaaataaattattctcctcattttatgcctgcaaattgattttgtagaacataattaggatgatctcaatattcttttttcttttttttctaagaaagggaagggggctaacccccaacttgccacctaagtattaaagagatttaaaccccagtcatatcgaggaccatagtcaaataactttattagctgccactagaataaaataggttattagcgatgaaaatttttcatcactaataacctattttcgtcgctaatattttatcatcaataattacattgttgataatattttataacagaaaaaaatttcatcgcaaaataatcgtttatttacgatgaaaaatttttatcattaaaaaaatttattttctcaaaaattatttacgataaaatattttagatgtaaaaaaaatatttgtgacgaaacttaacgtcgctaataaatattagattaatagcgataaaaatattttcattgctattaatttaattaaatattttcttttaaaatcaaatttttaaaaacttttagcgataaaaatattttcatcgctaataaggacatttgcgataaaatttttttcatcgctattaatttaattaaaaatatttataaaaattaaattaaaaatattagcaataaaaatttttcatcgcaaatgcccttattagcgatgaaaatattttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagaataccttctatatgtgcgatgtaatattatgaatggcaatattttctatatgagcaaattgaaatgttctttatgattgctatagtgagggggagtctctttcatttttttctttaaaaagcgagagtaatgattctaattgatgttgtcaaaaagagagagtagagaaataaaatcaagtaataagtaaaattatctaaaatcgagcaataagcaaaattttcaaagcaaatttgtcaaaagaaaataatcttataagctatcttaaaactaatcttcaaactactcatgatgcttactatttaaataactgactataatgtttaagtgatgcatcttcataaatttaaaattcttaatcaatactttatatatgttatatgttatattttgcttttgctcaaacattttatcatcataaaaaaggaagagattgtttctccttgaattgattttgatgattacaaaatatttgagggggttactaatgattttggcttggaaaaagatttattatatttcaagagcaaaactgatttgaaagtctcaagagtaagaacagaagatttgtgatctattggagataatttcatattattttggatatgtattttgagagaaaatcaagtttaaagaaaaggatcgacccttagggtcgatccctgtcaaaagggctgaatgacatgatatttttgcctagcacacccaaaggggacgatcctatgaatcgacctctgttgctgtgtaagccaaagatacagaacagtgattttctattctgcaccacagaggtcgaccccatgagtcgaccccctgtgacggaaactttcgtaatagctagttttcaactctttttgacagtatttaattctcttttaatgattttcaacggctctattttcagcccagattactctccactatccattgaagatataaaggtacttaaaggagaaaaaaagcaagagattcaagcattgattttagccctaagcaaaaagacctcttcaagcaaaaaaagctttcaattcaagttcaccaatccctcaagagctcattcaagtcttcaaccatcttgagaaaaattataaaagcttccttcgtattgtgtaaagtgtatttaaagttttatttgctcattaaaggagctaaatttgtattttcgtgtgattaactcatatactctattttgtcttgatctttagttttggaagggttccaaaacttggaaagattagttcgaaccttgaatcggattgtattgggttggcttatacccaaaaaatatgtgttctagcttgagatagttagagtcgggggtatcgacattgtattcttgattgaatacgttttagtggagttaaattctcaagtaggagcttggagagtggatatagatgcaaggttggcaccgaatcactataaatcttgtttgtttgtattgtgcttacttgctctctttctaaattttttttatcttcttgcattcttgcatctaatttctacaccttgcttaaatcactttttatatatatcctgctcattgttatttaatcctcgtgattctaaattaactttaaaatttcaaaaatccaattaacccctcctcttgggttgcatagctgggcaacactttgtactttatgacttttggccaatccatagaaccaacaatctatgcaaaattgagcaatgagacagattcagagaaacttagagatgaaaagtattgttgcaaataatgatcaacagtttttaaattttttttatttttttcatgtattagcgatgaaaaattttatcataaataataggtatttgtgatgaaaatttagttttcatcatcaatactctattatttacaacataatattttcatcacaaataatctgtaatttataaatttttaaaaatttttattttctttcaaatattagtgatgataaatttttatcataaataatttatatttatgatgaaactttaatttttatcgtcaatactccattatttacaacgtaatattttcatcataaataatttataatttttaaatttttaaaattttttattttctttcaaatattagtaataaaaatttttcatcgtaaataataaagtattgataatggaaaaccacttttcatcgctaatactctagtatctacgacataatatttttatcataaaaaatctataatttttaaatttttaaatttttttatttttttcatatattagcgacaacaaactttcatcataaataataagatatttatgatataaatttaatttttatcaccaatactctattatttatgatgtaatatttttatcataaataatctttaattttttaatttttatttttttttaattttttttaaatattagtgataaaaatttttcatcgtaaataactagtatttatgataaaaaataagttttcattgtaaatacttatattatttatgatgaaactattttcatcatgaatatttaaaaatttaaaattaaaataaatattttattatttataatgattaattttatcataaataataggtatttatgataaattttttttcatcataaatatgaagttatttacgatgaaaattaatttttattataaatatttcattattagcgatgaatttaatttttcatcataaatagtcttattggtgatgaaaatatttcgtgccaataaattcgtcgtgaaaattttcttttcttgtagtgtgcataagctggcaccaataaagttatctcaaaattcatattaacctatatatttcaatggtgtgccaaaaatattaatttcttaacttagcaagatttttcaactatttttttctcttgaattttcttttgtgaagcttttcatgtcaaaaaaatttgtccaaaagttaaatcatgaacctcttgatgaactctaacgagcaagattgtacttggttacatgatagaaaaagatagaataattatttttattctatagaatccctccaaagaatgacctcaaaatttttttttagtttttgttccctaatctttagagagaaagaacataatccttctaggagagagagagagagggagacacaactttattataattatccaaatatagatattttggatacatcactcaaaaatcaaagcttgaatcttgggttgttaagcaaagaaatgcaaccatcaatgaaagttgtagctcacttattattgtttctatagtcattagaggatagctgaaaatgatatttaattagaattaagaatttattggataatagttgacacatagagaaaatttgaataatttaccctctccttctctctattgcacacgatatggcaaagttatttgttaggtttgttaattggccaataactaataaaaaattaaataggataaaaatttataatttgttagaataaaaaataatctttcacttaaatttttctttcttgcaactgaaaataattcagtcaacctatgtctaaggtggatttacaagacttgtttacaagaaaagtatatgtctatatttattttaaagttaaacgatatagaaaattctatgctcgcatactttttttcaattctggtatatagttttaagttttgcaattagcactggatactttattaatttattgttacaatattggcttgtgattaactaacatctaattttgctattaaagtacccccataaaaatgatatgaaaattttgaaaatgacatgaaaaataacataggctttcattcaaaattagaggagaagggggtgagagagagagagaggaggaggaggggaggagaagaagagtagttaggtatttctattttgtttgtagtaaagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagggagagggggaggagagaaagagattaggatttcattttgttgtgaaattgggtgtgaaagagggataaaattgaggtttgcatttggaaaaatgcaatgaaaactcttggaggcttcaatatggtcgaaaggatagctagcttagcaacatctatgatctctgaagatcaaatatgatgccatcattaagttaaagctagctacataattcataaagtacaaggaacctagaaaggagattcttgcaatatcgatcttaaaagatgtgatttttttaaattattaactgacattaggaaagctagtagttattgatttagtggaaataatattttgcaaaataatgattgtattttttccaatgggttgaccctagtatttgtgatcatgaaaaaaatgtggctatcatattattgagtaaccagagggaggaacttaaaaagaagctttgaataatggaggagatgaatgaaactaccagaaaaaaggtgaaaatattgaaagagaagaccattaaaatatgaatattaaaggcatgagattgaaaaattgaaaattgagcatgcaaagttatagaaggagaacaaatacttaaggcatgagatttcaagatacaaaggaagagagaagatgtacgttagggccattgtcctctcatggatgatgatggtagtgatttataaattgttatagagggtgaattgaaaataaccttaattattctagccttaagttctactatttgatgtgaggcattggttgaggtttgaagtgagttttgattgttgtaattttatggtaagaaatactattctcttgttttgctaggttatgtgtgcattgaatatcaaataacttttatcatatactcatgttaggctaaggatatgaactatgatgaatgaatatgattatgttattttaagaagtgtgttcaattaattatgaagtttgctttatgattatgttgctttatgaatattaagtttgctttatgcattttaccaattttaaagcatgtaagttgacccccaaaatcaattaagatacctacataattggttactaaacatccaataaagaatatcaatatatggaagcatgcttaatagcatatgtccttttgtttctttttttttttgttaagactaacgattcacaccgttctagtatgaaaacatctaagaaaattcgaaaaaaggacatccctgagagccatcggagtagccataatattagtctatacaacattgacaaagtgctcaataatataagatactacccaatcagtacttctatttatcttgtgatacacatacctcgcaagaaatgagatcccctcctttgcaatccaccaaatatcctgcaaagagcagataagctttggaatgcctatgctacatcttaatccaactaataataataattgtggctaagtcacccttcattagaatggagtgagctcctaagatgcaccaagcataagtgcagctttgttgggcataacgacttttgttaatcttggattgttcatccttgtcctttcttttgttccctttaggccttctaagcatcttcttgatggaagaggataaaaattattggttcattattcactcgaggtaacatcttttggtcattcaatagttacaaagtacactaataagtcatcaagtatgccttcttcttgttgtaattatcaatatatatttttaaatcttgcttcatccaattaatgtatgagattgtatggatacaaggtatatcaattaagccccactctctatataaataagatatctgattaaggtccataatatattttttatctaaaactctaactttaaactttaactctatattaggctttggagtacaaaccgtagaccctactttagctttctcttgttctttttttattcgtaccatcacttgcttctttttatcatcctctccatcaatacaacttttatatcttctagcatatctatcataggattttgccttaaacaatattgtaaccattaaaagtctttactagattattgacgaagatgtcacacttgaaaaagttattaataaatactttatagaggtggtgtggactctagtacatataaaatcatgagcagtagccttccctgacaagtcttgcatatctttaatgtcatcattaaaatctatcagattgtgacctttatagtaaccaaaaatcatttttcaatgcatagccaggattggattttttctagttagcatatatgtgtctagcatagttcttttgctctgcatatcaaattaagtttctgactgtattaagaaggccttatgataaataaacatcacatattaagatattaacaaaatacaaaaaaattaaacaaaaattagaaaatgaattattaagatactagttgaagtactttttgttggtcactaattattatgccactatatccatcatgaatttcaaaatcatcaagtagtatttctaagaatcaagtctaagtactctcattctctctctccacaactaatcaactatagggaatatttggttgttctcatctttttctatagcatataaaagttgatcctctaggaatgtctttgagaaacaaccatctatgctaatgattaacttgtactctactagcaaatctctctttaaagcatcaaagccgtataaaatctataaaaatatggccttaccctaggaaaaggtctatcaacttcaacattaaaaatctatttttgtttgttcttctttcttttacattataggaccacaaattgctgtaataatcttttaaaaaacctctaggcattgtcagtgcccttcacttaggtctatagcattagatcctacttatagttaaaacatatttctcttttataccttcttccatctctttcctaatccaattagaattaatcttaaacctattgatgcattcctaagcaagcctcaaaattagcttatctagtccttaaatttctacaacacctctatatattttcaaatattttcacaataaataacttttccatctacatctagcttgcatatatcttccaaggatgcttgtttacccatttggccttcatctttgtttttatcactcctttcccgtctaataatattgcatttattcactatagcatatctcttaacaatttcattaaattaattagggtcctaaaatttcatccttagttcaaactttacatctcttttgtcattattttgaattataaaaacaatactttactctcccatcccttctaaacttaaactactcgtcctcagtttggagttaggactttagcttcatattcactttgataattaaccattcaactcttttatctttttttattaatctatataaaatagataggttccttagctttcgctataggagcattagccctattttgaaacataccaacactttcgaatgtatcaactccactaatgcccttttctccaagagctttttgcttatatttagcttctagatattttcatcatcttttataagctcatcaccactcaaattatccttaattctgttccattggcctatagttaggatcatcatcttcatcattagcaaacacaaactaaacatcacataaaggactatcaataacaggcctatcattcaccacaagtgttacaacctgtctatttgcatcattttcactcaaagtaattgcaatggccaaagtattgacctctttatttttatccttgaagtcctgaataactacaaaaattttatatatatcactatagtcctatgttaaagggtaatgtgtaccatgtctatcactttactatcccttctgacttctctaatattctcacttagattcatgtttaaaattttatatcatattcttgacatctgatatcctaactctctgatcatgtctattaacttaaagtgtgaaatgtaacaatctaaatcaaaattatcccatatatcaatctttctttttaggtatgctatttctgattacatttataaaacacctctatgttgcatcggcctgttaaatctttttctcattttatatggatgatgaaatcacaatatatattggtaagcaataaaatataaaatttattaaatcaatcaatatcttactatgcattattttaattattttattttaattactcagctattttaaacaatatcactaacatgctatgtaatacatgaaatagtgtacaattttttagctcaacttattaacatacaacataactattatttcaatatgttcaaatctctatccacttaattgtacaacacccaattctgataaaaagtttacaacacccaacacctaaccgagtcaatatttgatgatgcagtactaaattatttaattaatcaagctcaataaacaatacttattccatactagggtttataaaaccttaataaatccctaataatccctaattgattgttacccagcttatttaaacaaacaataggcaataaaatataaaaaggactcacttttgtcatttggcataaagagctttatggcttttcttcaaatagttcaataggggaccaccaagagacaattcaattactcttttgttgctaagctagctatcctcccgactataatgaagcttctaggagcattctttataatttccaaatgcaaaccctaatttcatccctcctgcctcacctatagttatctcgatccctaatctcctaagtctggcccttcgtatcaatttctttctctctccctttccctccctcccatatcttcttttataactatgaaagaaagcttttgttatttttcattagacatgggcatcgggccgagccacccattacacggtccggcccagtatgaattggcacgtctcacttactacagtaacagattgtaccatatatggtacatataagggggttggactaggttggaggttttgcggcccgcagtccaggcccagcacagccaataagagcctgggctggtacaacccatgggtcaggcatggcccgacccatgtgccagctcagcccccttaagtagtcccatataaatagtcccctcctcttccattctcatcacatcaattcatcattttctatcatacccatactaattctctctactattatttcttctattcaattgctaaagttttcaataatccgctatttttttttattttaatttatattttttatattagtcatgatatattctaatgatagtaatatttctaaattcatatcatgttcaaaagatgaagtcaattctaaagaaattaaaactcgatgagaggatgcatcgatacagaattttaagcgagtaagatcatgtaattacgaagaagattttcttcagaatgagattttagaaaattttgcctcaaaaagcatgctcctacaagaagaagagaaatttcagtcaaatgagacaagcatcctggttgtggtcctcctacgaaataaaattttcatcatgtttctaaatcatttggttcttttaataattctaagaaataaaatttttcatgcttttaattttgaaaaaattcatcattcattaatttttttaattttttaattttaatatgcattaatattatgaatactaatggattaaagatacaatttttttcattttatatcttctatctctcatatatttttattacttaatattttttattttatattttaaaaattaaaaaaaaaaaagactcattaggcctatcagacatgcgggcctaacgagccaacggcccatgcctagcacggccggccatgcttgggcctagggccatgtcaggctcaagattttatttaaacgggccgtgccaggcatgacctgtttactacatgggtcgtacttggcacggcccattaaaccttcagcctgatgggtctgggccgtgcctagcatggcccattgcccatctctatttttcatatgatttctaaaatttttttgtcatttccatggagacatactttagtggcaaaattacatgctagttgatggcaagccaatgttgcaacaataaataaagtatctacctcttgtcaaaattgaaacaatatgttggaattaaaaatatataattatagagtatattgtgtcattagcatttatcttaatgtatgtcatcaagtccttcaaggaagcttttgggccacgcacacatatccatagtttttgcattgaatccattccttcaattggccatagtttaggagggttagttcactactgcactgtatgccaataaaccccatccaaagagagaccagctatctgaaataattcaaaataacaattttatcccctaagatagatgacttatcagctgctagggaactagtttgcctagttattttgtggacctagctgaaggcagaactggcaacatatatatcgaagatgaagctttctgaaatcggaccctgaagagcagaaccatcaacatatatatttagaagatgaagttgtccaaaatcgaactccaaattttggcccagcatttgagacctatccagcttacggcatgtacgtcacatagggctcaatagttgctaaggttaatggaggctccgaattgcttcaaactctttcattcgcacaaaaagaatgatttatcttcttttgtaagtttagcactagattgtgttctcaaaacactttaaacacctacatttatcggctacatatataatcttgaagcaactattgcacgatccaatagtagattcacgtgaaagatcaagattaatcattctttggtgggaaagatgtaccccaaacccctatgtcaacctagtcatagaaaatttcttacaattgaagtatgtaagaaaatgtcaattggttgtataacttggaccagcatcaaccatatgctgagatgattggtttgaagtggaaagaggagcttactaagtttcatatttcccatcaaaatctaccttataaagtcgtgggaacttcgtataacatggattggaaggattctcaatggtcatgaatcccatgaatagttgatgcccaaaagaaaaaaaaaaaaaaagccttatctatatgaaccgattttacgtctaaaagaaagtctataccctatgttaaaatttcaaattattgaatttcaagtgggctccgaacatatgcaaccataagaaaacttgtaaactacagtctacctttgtacgtacccaaaaaaataaaaaactacagtctacctattgtaccattaaacaaaaaaaaaattcctagattctgcctagctgattgtctttttcatctagaaatctggtcggtagctactaatcaactaacaaagcaaaatcatttccgtagttaagaaacatgtaaacgagtccaaacgaatgagtcgtctggtaagcattttctgaacccatgatttctcctcttccccatcaatgcaagtaatttaatcaggctcctttctcagctcattaaataagaaaaaattacctataagtctctagattgatctaaaattacttttaaatctctaaattttttagattccataaaaaatctttaaactgctaaggaattatttctagatccctgtcttcacacaaattggttacacagatctatactcagattacacaaatttatgttcaagttatataaatttatattcagattatctgcataatctgcgtaatctgaacataaacctgtgtaacttgaacataaatctttgtaactttaacatggacctacgtaatcaatctatgtggacggcaggaacctaaaaataactccttaacaattcaaaaattttttatgaaatctaaaaaattcaaaaatttaaaagtaatttcaaatttatctagggacatatagataattttttcattaaataaccatacatgctttagttttctcctttctttatcgattcatccgtcattctctgcaacatttcttgattcacaaggctacgtccatgccttaattctcacatcacaccttccacccgaggcccaacccaatcaccccataaataggggtcctcttcccccttcttccctcaagtccatcactctctttcccagctccaaaaagtcaaatcccccttcaagccaataagcaagaaagcaatcatgttgaccaagtcttccctcctcgcccccttcatcctcctgatctttctcattgcctcctctctcgccgctgatcccgatatgctccaagatctttgtgttgccgatttgaactcccgtactttcatcctttctcttgttaattaacaccataatacatatattcccgtcttagttttaatattttagtccttttttttttttgtgctttttaggatgaaattaaaaacacatgcatcaaaattaaacacaataattaagcatgttttggctattaattgtagcaatcatgcttctgatgattgacgatgcatgcactgcagctgtgaaggtgaacggatttgcatgcaaagccaacgtgagcgagggcgacttcttcttcaagggactggccaacccaggcgccaccaacaacactctgggatccctggtgacgggggccgacgtggggaaaatcccggggctcaacacacttggcgtctccatggcccgcatcgactacgcccctggcgggctcaaccctccccacacccacccccgtgccaccgagatagtcttcatcctatacggcaccctcgacgtcggcttcatcaccaccgccaacaagctcatcaccaagaccataaccaggggtgaggtcttcgtcttcccccggggactcgtccacttccagaagaacaacggccatgtcccagcctccctcatcgccgccttcaacagccagctcccagggatccaagccatcgccgccaccctcttcactgcctctccgccggtgcctgatgttgtgcttgctcaggctttccagatcagcaccaaggaggtggagaagatcaaggctggccttgctcccaacaagtgatcatatatgtacgtaagagagatattagacagcttgcatgaatttgccgttcggtttgtttgcgagaagtttcagacttcaaacttacgaattgttgtgcgcgttcgtaactcttggcttctggttagtttctttggtgctgttctgtaacgtcactttgtttcagggaggatgacggaataataacgttctatatatatattatataatatacggatctcaagtgtgccgatttcatttcgatctgtttctcctgtttctggaatataggcattaatgaggctcccatcttaaccaccaggagcgcgatcacgacagcaaatggaaagatggccactacctcatccgcctttggattttgacgttgtacgtgctcaaccgatgatggccccagccccacctaaaataaaggcttacgtacctcccatttctgtcgtgacctcaatcggttggatcgtgttttgtgcagctctcggagcgcaatggagtatttctttcatcctcatcaagagatcataaagtcgatgtcgtgctttaaaatctatacaaaatatagtccaatgattgaaattgcaaggaaagatcaattatttttttatgtaaaaaatataattcaattttttttttttttaagctttaacgcaagaaaaaaaaaatgttgaaaaggcatgtgtatggctgcatagacacaaaagaatttcgtaaagcgtgagcaagatgggatatccaaattattatcaaaatggtaggatgagagggcctatcatgccaaacttagaacataggtcaaaaggaatgagagaggtgtgcctaatctggaggcttgatgggtgaatctaccagatcgttcaacttttttagacacagagtacagggcctgtctataaatagtgacgcttcttcagttgctatcactgtcggtaaaaaaaataatatatatatatatatatatatcaatgtctagtctttattgttgtgtttctttggacagctcaattcatgctaccatccaaatcatcaagaaaatgaatggtcatccaacagatgtcaacaatgggggctgggcaaacaaactgttacgatggcatgtaagtgggttatcattgtgtctaaacatgtagaaaatatattatacgactagaaataatattattgataaagagaaattaaaatcttgattccatattattcaactttattgcatgcaaagtttcttcctcacgatccccttgtttttgcgatgcaagaaatggccccacaaaactttcttgagggattgcatagacattgaaaaatagcaataaaacaataaaccttgttgccatactcttcaaccttttcattgggaaagggaaacagaaaattaattatgctcctcattttatggctacgaatgattcaataggacataattagaattttctcaatactttatttttttttttaaaaaaaaggagactaatctctagggatgataaaatcaatccgatctgataggtatgcaccctatccaaatttgatcaaatttgaaaaaaagagtttgaccaggtttggattcgaatttggataaaactcaaaaaatatagcacgaatatgagtaaggtataggtagtgctgttttctacccaaatccaaatccgaatctgatccgaatctatgggtataggtaatattcgaactcatattcgaatatatatatttataattctgttttgataattctgttttggttgataatatgcataaaattattttaattatttatatgttctatgttgaattgtaattctatttctatgtttgatttctataaatctgcacttataaattatgttctatattgaattgataattttattttgattgataatatgcataaaattattttgattgtttatttttttgggtatgggattggcatgggatgtgtataggttaagtatggagaaatggattatccgtagatatctccgaacctattgggtatggagatgggtatctcttttcttatctgatcggatatcggatagtatttgagtatagagtattaagttcaaatttagagatggataatataatacccgatccaaatcctacccattgccatccctactaacccctagctaaccatccaagcattaaagagattcaaacccaactcattgtgagtactacagccaaataacttttttaactgcacaagccagcgctaataagattatctcaaaattaagactagcctatgtgtttccaatgatgcgcccaaaacattaattcgtgagaattcacgacaatgtctttttttttggtgaagctctccatattaaaaaaacttgtctcaaggtcgaaaatcatgtaccatcctaatcaaatcaccctaataagcaaggttgtgcttggttacataatagacaaagatgagatagttatttgtattctccagtattcttttaaaaagcttcttctttaaagtcccaatatctattttttgaatttttgttacctaatctttctaagatgaaaaacatgatttaagggaaaatccgttttgaatagtgcttgttttcccgactgttgtgctttgagattatcgctgcggccctattccccttgatcgtcagcgatccgattggctgtagcgagcgctgtcaccaaagaagtatggtagatatccctgtgaactacgcagggacctctaaggcaagagctaagctagatttgagttggtgaagggcgatgcaaggccgcaccatatggatctcactagagccttcgccaaagaggtggaggatcttatgaagtggtttccaaaactggtccacttctcagaggaggagttgagagaggagtcagcgagttgggcggccttggcagtggtggcgaggagcttcagtcagaggtggtgatggagatagtggcgagggagttccggctacgaacaagggttaaaagtgaggtcactataagaaaataagatattagcgatggccattagcgatggcgtttctccatcactaataggtagtattagaaacggcattaccgacggcaagttttccatcctcaaaatttttttaccgacggctattagcgatggctgaaataccgtcactaataagagtttttagcgaccaacaatcacgacaaaaaaataaaccatcataaaaaaaatatatttattaaacttattagcaacgaccggcactattaacaatggatttagcagtcgtaaatatcatttaaaatttttttttatttattaaacttattaacgacggcagaaagaatattagtgacggcaatcgctgtctctaataatcattagtgacagcactattggcaacgaaacttgctgtcgtaaaaaatatttttttttatttattaaaattattagcgatggtgggaaagtattagcgacaatatatgccatcgctaatgattattagtgatggcactattagagatttaattcgtcatcgcaaatttttttctatttttctttgaatatgacataattttagaatttaaagtccatcttcatcattcattatctaaataattatcgttagagtatcataacaaaaaaaatcatctcgatctggtgaccctagctatgttgatcaataaaatttattttcgatgaccacgaacgatcgcatgatgatcttatagacagagaccaccgattgatctaaaaatttacaacgatgatctcgatgatgtttatagcacactatcaaaattttacttcaattaaaaatcattattatggtcaatttagtacaaaataattttgaccattaaaaaaaaagagtgatcaaaaggcacacagcgtccgattaagatgattttttagataaataatttttgttaatattttaatcatttatatggtggtgatcataaaattcaaatcatacgtatgtgaatcatccatattaagtatatcttacaaaaatataagtataattacttaaagattttaagaatgagtttcaagagacatatagttttggatcgttcatacacgtgctgtttgaattttacgatcaccaccgtacaaacgatcaaaatagtagcaacaatcatttatctaaaaaatcatcttataatcagctgcttgaccttttgatcactcatttttatttaacgacctaaattattccttgctaaattgatcatgataatgatattcgattaaaataaaattttgatattatgctataaataccatcgacatcatcgttgtaagctttcggatccatcgatggtcttcatctatcagatcatcatgtagtcatttgtaactgtcgaaatcaaattttaatgatcgacatatttaggactatcaaatcgagacgatcttttgtgatgatactctaacgataattattaaaataataaatagtgaagatgaattttaaattttaaaattatatcatattaaaaaaaaatagaaaaaaattagcatgcataaaacttataatggaaagggttattagcgatggcttttagtgatgatatttttgccatcgttaatagttgtattagcgatgaaaaactgactcgtagcgacaatgaaaatcgtcactaataaatttaatttttttaaaaaaaaatttgataataattataatttaattaattaattatcgacggtcattagcaacgactgcatttatcatcatcaataattatgaaaaaaattatttaaaaattatgaaaaaatattttttctgataaaagtattagcgacggctttaacgacggaatgccatactaatacttttaccgacggcattagcaatggccactttaccgtcgctaatactccacctatttaccatccatcgggggaaaaatttttcgctcatatgtacctcatcctctccccttcctgcaattctcctctcatcggtgcccaaacccccttttcctccctccccgccccatccctctggcatcctgcagccccaagcccgcatccctccacgcctgcggccgcctcgaccccatcggccccaagtttgcgtctctccatgcccacggctgcctcgacgaggtcggctcgaccccgtcggccccaatgtcgtcagcctgaccctgcggcccctgccccaccaccccaactcacgggccctccctgctagtctgaccccatggccccgacctgcaccgccttcccacggccccgcctccgcacctttgtttctatgactgcatccttgagccgccaccttgaccccgcggcctgccctcgtgggacctaccccagcacccctagcccatggccccaatcttgcggcccgaccacacggcctcatctctgtggctgcatccccgagctgatgtcccctcgcctctcagtcctgtgcgccagcccgtgcctcagtccctgcacggtagcccaccttctattacgaggattagcaatggcattagtgatggcattagtgatggcattagcgatggctaatgccgtcactaaaagttaatttttttatttaaattatattaattaagtataattagatattaaaaattaattaaataaatattaatttaattaattagttagataattaattaattaattagaagcacatgacttgtgtctcttcatgcagagtgctcggttcgagaaaaggtgccaaacagcattgcaaacacggggctgggttgtgccctacgcgctcaggcctcgagtcccagctggcatccaaggcatccagccctcgcatgccatacatcttcagccatgtggggtggggggctcggagaggcagtcggaggctcggagaggctatgatgactgtctgtacgagatgcacctaaagagtctaaagagagattgatggaggtaatgcatttttcttcttgttgtagttacagggcaaacttggatggccagttacatcgcagacaactgcttgcagccacctcatggttaaaggtgcagaggaacttgcaatgccttattttcaatggcagatctgagctttcttcttttcctctttcccttgtttactttgttgttctctaatttaagtactgcttttaagtttctattttatttttttttaaatttctactcttagttttcgaactaggctcgggtagggatgggggcctcaggaaggcggtcgagggctcgaggaggctgtgatgactgcctatgcaagatgcatctaaagagtctagagagagattgatggaggtgatgtatttctattcttattattgtagttgcaaggcaagtttggatgatctgttatatcgcagacaaccatttgcagccacctcatggttaaaggtgctgaggaacttgcaatgccttattttcaatggtagatttgagctttcttcttttcccctttcctttgtttactttgttggtctctaatttaagtactatttttattttatttttnnnnnnnnnnnnnnnnnnnnaatttaagtactatttttattttatttttaaaaaaattttttgctcctaattttcagactgggctcaggtaggggtggggagctcaagaaggggctaggggctcagagagactatgatgactgcctgtacgagatgcacctaaagagtctagagaaagatctatggaggtgatgcatttttgttcttgttgttgtagtacattgcaaacaaccgcttgcaaccacctcatggttaaaggtgcagagaaacttgcaatgccttattttcaatggcagatctgagccttcttcttttcctctttcccttgtttattttgttggtctctgatttaagtattgtttttaagtttttattttattttttaactacagcaagttggtttctaatcatgattccaaactcttttgcatacttatcataagaaaatctgtaatatttggactcgagatgcacacttgaaaggtagaatcaagttttttagttttaattaacttagttacagaccattggattattggccaacaaaatacatcattttaaatcttgcattgtcatccataattatataattgaatctttcattgccacccatatataacttctttaatgttgtccttgatctacggaagatggtacaccacagcagacctatcgctaaacccgccaatcgatatcgatcctccatcagaaagatcagatattatataagattgttagttggcaactgcaatatatcagcagaaaaataattctcatccagcagtacatgataatatgttggtctgcttttatgaacatggtacaaagttaagatatccctactccaagtattctcatccagcagaaaagctatttttgcttatgctagtttttgatatgttgaattttgaagatcatactatccgatgctaatgtttctggggaaggagaacataaaatcattgcatttatacggcttcaatgcaaccatcctaattataatccaaatttgcatcattgcttatatggtctgactgcaaagatagaagtcaaactctatcggatgataaacactgtcaaccacagttcctaatcaaactattataacgttacttcctacaccaagcatacaaaataccacgttatttttatgaatgtgatacaaaattaaggtatcatgatatacagttaaataaatataatatatagttattttattctggtatacagttaatccaatatgatacatagttattttattatgatatacagttaatctaatatgatatatagttatttttattttcaaaaattatagatcatgtctttccaaggtcggagccattacaactgaggagagagctctcatatagccagctcgcatgattctgcatctctcacaccagatggtaaactctaacactttagatattttggtttatattattttatcctttgctaactaatataatattctttatattagatattttatacttcggttcgaacgacagaaggtcaccaataatctcatagtcacatgcagtagcgatcgactcccagacacagtgtcgtggttgaggatccactcggctagcagcacctctaactcgactggaggatagatagctcaaccatgttcagagccactcataaatactacaacttcaattaatatgtttagaatttagtcattccagagttaacatttatttttcaaaatcaattttgtagtacgtttagagagcctggagtatctcgtgtggttatcagcaccatccgatgcttgatgtcggggtcgatgaatgagttcttcagttggccgtctgaagctcgtgatgtagtctaggagatattttgagtaagtcagaaatatttaatttttaaatttatggtatatttatattctacttattaatatatgcttcgattctatcttgcaagagtattatcgatttgagactccccaggatgaggaggctgatcgttggatcttcgatgaggtggccacacggaggcttcgagatggcatctatagcctcggacagtctgccatcgagcattctggttctcagtcaccatcagactgaaggtcctacggggatcactggatatggacggacgtatgggaggccctctgtgattagtggagcagtgagaagtatttcaataagtgacagagggcccgacaaaatcgaaccacccagcaggatctgatcaggcacatggacagctccgtcggtacatatattgtggccgacagactagtaaaaaatctatatcaaaatatttcactagaattgtgaaaatttttatatgtatgctttaattaatttaattttattgtttacttattgtaaatatgatagttggatgatccactaggtcagctgcagttgtgggaggccacacaccagtctaggagaactggtgattatttagattttagattgcgacaaattactgtaaaaatttcaaactatatttattaagttattacaggatctaatatatatattagaactaatatatttatgaactgtgaaggtgaattatgtggagtatgttgttgcacggcacgacgatgacctatccactcaacacctccgtgaccttgagggacggctcaggatcatcagaggggtgagtaggagctgggtcataggatacggccatagcttcgaccctctagtggcttgatactctttgacgtcctcacaggtctcgacgtcccagacttaaagtgatgtgtacgtggaggagatcgtgtagagacttctgagctagcaatctcagagccttcggaatgccatccatgatacgatcatgaagattctttaggattcgcaactatgtgacctgctaaactcattatctcaaccatcacattaggtaattctattagtaaactcttttacttgttttaagtttttatatttagaagcttcacatatttagacttgtgtcggagaaagagatctggaggctaaaaatttaatctaaccatccaatgatgggttaggggtgtctatagttctgtatcatcgaatgaaatgtgtaggaataatttattcgagaattgaaagagtgtatcgaaagatatgcttatatatcgaaacttattaataatattttatttttcttagtttcaggatgatgggacatctagctctcatccaccagctactggagaggagaaggaggacgatgaggaggatctggactgatttttttattttgatgcattatattttttgatactacnnnnnnnnnnnnnnnnnnnntttgtgattatcatattatctttggattttaattataatagatgttaggaaccataattgattgtgattaattaaaatagaattttaaaaaaaattataaatttttaaaaaaataaaattaactattatcgatggctttagcagtcactaataacaaaatattaaattttttaaaaaataaaattaaatattactcacaacattagcgatggctgacaacattagcgataacaaaaccatcgctaatcattcttaaatttttttaaaaataaaaaaataatgataaaatttagccatcgctaatgtcattactaataccaattattagcgacgactagaaaactcgtcgctaataaaagtaattaacgattaaattttttttaatcaccaattagcgatggtgtgccatcgttaatagtattagcaacggcaaaatgactattagcgacggtaattaactatcgctaatagtcagatttcttatagtgggttgtggggcacgggctggtgaaggggttctatctcttcagatttaagagggtcagagagagggattgggttctcaaacatccttgggtggttaccagataagtggtggcggtggagccctatcgtccgagattctttctgacagagggagccatcagcttgacattggtgtgggtccgactattgcggcttccgatggagtactagggtgaggcggcattgcaaagacttttgcatcgggctggggagttctcctcagtcgacaactgcatagtagagagaaggagggttgggttagattgggcttacatgaggatcgatttctccttaccattgagaccaggaaaacaaatcatgggcctgatggtgtccttctggcaaaggttcatctacgagaaccttgatggcctttgcctccgatgcagatgactatatttgtcggaggtgtgcctgatgggtggggaaggaggtgccttggtggtgggtctgagcttggagacggatgctccagttgaagggcaggggctggttgcagatgctggtggtccacgcttgggggcatccatggctagtggccgtctgccgatggtagcttgggtcagagagaccagtcagcttcaggaggaaggagactgagtcaactcggcctgctgagaccacactgaaggtaaatcaagcaggctcaaactaggtggactcgagaacaggaatggatggctagatcaagtcgactaaaattgcacaacagtgattgcccatctatatcaggcccaaccaatgatcggatcaggcaggatgggcactgagatctatgcagatagctccacaggcctgagcccttatgcggtcaggcccatgaatcactttagcttggtattgggctacaacgtaggcgagggaccatctacgggtgagtgggtgggttttactggggcggtctcttcccagcctaagagggcccgaccccctgaatttgatgtgggtcgggtgcctatgaagcccattgggcaaaattctgggaccaatgggtctagaaaaggacctgctaagctaaacaaggctaaagacaaggctctgatcctcccgaagaccctcatgaaatcagcaggtggcactggagatcctggagtcttcatcttctcagctacgacctgggaggaggggaggaccttggtctagccagaggaggtggcatctgatccaaggcccctaactgaggtggggccttggatgctgttgtccaactgagataggccgtctagggggagggatagtccatctgtgatgaatctgacggtagctagatcagaggtaaatgctcaagctaaggagggttctagtgcagactccctttcccactagctgtccgatgatgatgctgatttggaacactcagggggtggggaagctctcattccaatcaacctttggcagattgatccaacagcatggccctaaaatatgtgtcctgctcgagacttggctctctggagtgtgcttgcatgagtcagacagtgaatttcgatggtgtggagcacttatgcagtggagtccaggggcctatcggaagggatcttggtgatgtggatgcatggtccgattaggatggatgccttttacaaatatgagcagcaggtagctttagtcatctcagagtagaccagaggaccttgacttctgttcggagtatacacaaacactgagcataaggagtggagggagatgtggtctaagatcttcgggattgtgtcatagggcccgtccttccttatcgctggggacttcaactgcattgtaggaccccacaagaagatggatgataggcagtatgcaaacagtattgattctagaaagtttaggaagttcatcgatgatgcggatctgattgatcttagccactctagatttagattcatttggtgcaataatcgagaagggatagctagggtttgagagagaattgattgggctcttgccactacagactagctctagcactttcctgggcactagtccagcatctttcgaggatcatgttggaccactatctgattttcatcaccactgacggccagcatatatctaggggcccgttcagatttaagaagttctgaattttctatctgaaatcatgggatttgattagggaggtatggagaatactgattcatgaggatgtacggtactgggtgtctcagagattgaaactagctagacacagactcctccgatagaacaggcttgaggttagtaacatcttcaagtagactgaggaggtgaaggcggacattgtggagctatagatgagagaggattaagaggaggacctccagaagcctaacttaagggagctacgctgcaagctcttggtgcaccactctttgcttaaacagcaggagacactatagaggtaaaagtcgagagtgtagtggattagggagggagacaaaaatatcagattcttttactagttcaacataattcggagatctaccaatcgaatcagatagctaagagagagcgatagtatagtagtggatgacagcgaggagatcaagagacagatcttttggttcttcagatcatgatggatggtgcctatgggcgaggacaccctctttcaagggtcccaactagtgactcgtatcttcgatcagaagaatgagattctgacttatttggtgtctactgaggaggtgcgaggggccctttggtcccttagggaggataagactctggggttggatgggttccttcctcttctttcattggtattggcctattatgtgaagagcggtagtggaggctatgcagattatctttgacttcagaggtatcccgaaggagtggaaaaagactctgattaccctcatctcaaagcattcaaatgtatctaacttggggcactttaggatgatcaattttagtactattctctacaaagtatgtgccatagttttgatcaaatggctgaagcagattatccctcatttgatcagtccagaacatgatgcttttgtgagcgaccgatccatcatcgataatgtctgactcatccaggagttttgcatgatctatggtatgtccctagctactgaggtctcatggtgaccaagctggacatagagtagatgtatgatcgattgagctagcgcttcctgtggcagatgcttcagaagcttgacttctagggtaggtggattgattggatcatagattatgtggagcatttgagttttgccattctaatcaatgatgccccgatggagttctttcactcgatggctggaccacgtcaagattgccctcttttctcttacctatttatcttatatactgatgctctattttggacgttgagagcagcggttcagaggtcgaagctagagacctactggcttgcccctggcgtccaacctctcttggcaccttctttttgtagatgactgccttttgattgactggacctcgatccgaaatgtgaggtgtttttatctatcatcgaggcctattgtcaaaactccgaccagtggatgaatctgcaaaagtccacaatcatcttttgccctaagatgaagatctagataaagcagacgattcagaggaggctagggatctgggagcagatcgaagctctgatccatctgggggtccccatcattgatcgacatcttcgaagaaccgactgtaaacctatgtagcagcaggtctaggatcgtcctgagggctggcaagccaactcattctctatgatggatagaatgacactcgtgagatcgattctgacttccatactagtatacctcttggcaaacataattgtgtcgagctagtgtcttaggtggttggagcaattattctaaaattttctttgaggctttatgcatgattgtcatgggctccacttgctatcttgagagataacctactagcctatggaggtggaggctcgggatttagtattttttgttaggatagatgctttgatcatcaagcatgccgtcatattcctcatccagtcgactgtttgtggagcaagatgatgagggctcgatatggaccgtggagtcagagatccaaagttccagctcctcgaagctattttatcatctagaagaagatttgtgctcacactctaatagttttggctcaggtcaaatggttgattggggatggaaggttggtagatgttaatcaggatgcctgaatttctaacttgcctctttctcgatggccgacttacgtcagtatggagatggatgattggcttcgagtctgtgacctgctcactacagacagtagggattggagagcataggacatcgcctgtctcttcagtggcccgcttgtggatcagattctcaccgtcccgattcctatccatcgtagtcaggacgagggtgtggggcctttcttgctacccgagagctcccatgagagatctatctgaaatatgcaagcctacaatgagtatcaagattgaggcagcttggatctagagagtggctgctctttccaaggtgaggctatttctttggaaggttgtctaggaccaacttctgatgtgcactttactcagtgacaggggtatggagcttatgatctcccatccagtttgcaagttggagcataagtcgatggagcatgccctcctgcaatgtctgagagcgaggctgatctagaggaggacgggtggccagttgtgggaggtgagcaatgatccttggttgaaccattttttggatgcaatccactagagtactgttgagaggtcaatctatgcctggggtggaagaatggcgtatattgcctaccagatctggctctccaaaaatagcttggtcttcgaagcaaaggtggtacctactcatcgaattctagagagagccttttatttgaccatcgagtatagctgctttgacgctaatggtatgttccttaatgtctctaatttttggagctctgatgctgctcctgtagcgatttgaaggattattttcattttttgggataccctcttttgggatatatcaaggtaaattttaatggcagcatcaaagatagcaggggtgctgccagttttatcatctgggggtcggatgctagattgctagtggcaagaggattgtatctctttgagccttctataccgagtgcaaagcttcacaccacatgggctagtatgtctgtgcccaacaagagctacgagctaagaggatcatctttgaggacgactctgccaccatgataggctagatttaaagcaatgcaatgcaggtagatgaccatttactcctttatgacattcggacttgccttcaagacttcacggtggttttggcttagcacatctttcgagagacgaatagtatcgctgattggatcacctcttatgtgactaagcacacagaagactagatctggcatcagagactgacttgcccacgagccttacaggatattttattttttgaccttttaggatgcactcatgctagattggtgtgagcacaagtttatacaaaaaaaaaaatgattattttaagagagagagcgagggagagctaaccatattacaattattgaaatataaatattttggatctactactcgagaatcaaagataaaatctatgattgtctgccaaagaaatgttaccaataaaagttttgagtcaatcataaaaggtggaggatagctggaaatgatatctgattagaagaaagagtttatcagataataattggctacatagagaaaattcgaataacttatcttctccctctttgttgcctacactttgacaaagctatttgttaagtttattaataggccactgactaaaatcaaataatctaggataaaaatttatgattggttagaaagtaatattttatttatattatccgatcttacaatcaaaaacgatggacttacaaggcttatttgcaagaagagcatataatatttatcttaatgtatgccatgaactccttcaaaaaaattttcgggccatgcatgtatacgcaatatttacatataatctattctttcacacggccgtagtttaagtgggctagtggactgaactatatgctaataaaccccattcgaaaagagaccagctatccgaaacgatcccaaataatgttcttattctccaagatagatcccttacaagccacaggagaaccaattcgtccgataattatgtgggtctgaataggaatggagttgtcgacatatttaatagaggaagatgtttgaaatcggatcaacttacattcatgcaaagtagggccaaatttaatgtgagaaaatattcgttacaacggtggtattatatcactgttgtaatctatcaattaaacattaaaaataaataaaatatactgatagtataaaatatcatctataaaattgataaaatatataaaaataataaaacataaaaattttcattcatttattacaaatttgatcgtctaccttacgttcatgcaatgcaaagcagggccaaacataatgcaggctcgctgtagagacagcaggggtcccatgcagcattaatgttgctgcatatagtacattatgccttaaacgtttaaggcgtaaaatggaccagcgcattaatattccaattacgttaactgggctcctcgccctttcttcttgctaattctcaccaattaatggccccttttatttttcttcctctttattcctccaacctcctcctctccctccatccccgcatttcttggtttgtacggactttactctgacatcacaccttcctccactctatcccccaccccacccacccacctataaacgctctcctccttcctcttttaattttaacccaaggtcccccagccaagcatctctcttgtgcctccaagaagtcaagtctcccagccagcaagcaagcaccaccatgaagaccaagtactcctcctttctcatcaccctcttctctttctgcctcctcctcctcgccgttaacgttgccccttgcctcgccgccgatcccgacatgcttcaagacatctgcgtcgccgatctcaactccagtaatcccctctccctccccttcccttccccttgtgagctacctcatgatctcttggtttggtttggtttggtttgatgatgtaattaattcccggctcgatttgcttctttgtttgatgggggccgggtgctgcagccgtgaaggtgaatgggttcccctgcaaggcgaacgtgacagaggatgacttcttcttcacgggattagcctcccctggcgccaccaacaacaccatgggatccctggtgacggcggccaatgtggagaagatcccggggctcaacaccctgggcgtctccatgtcccgcatcgactacgcccccggagggctcaaccctccccacacccacccccgtgccaccgagatgatcttcgtcctctacggcaccctcgacgtcggcttcatcaccacggccaacaagctgatcaccaagaccatcaccaagggcgacacattcgtcttccctcgcggcctcgtccacttccagaagaacgacggcgatgcccccgccgcggtcatctctgccttcaatagccagctcccgggcacccagtccatcgccgtcacattgttcgccgcctcgccgccggtgcccgaccacgtcctcaccaaggccttccagatcggcacaaaggatgtgcagaagatcgagtcccgcctcgcccccaaaaccaagtgagagacggcgatcgatcttgtagatttatcatgattgattattactttgtgtttggtcttttgttttcgagaggagaggagaggagaggagagggaattgagggagaagaaaaaggggcgtgtgtaagaaataataatgattgttccttcttcattcaatcatatcgtaaagatgtttctttacacctcaaggccaatgatttcgtttctttcccctttttaccgaaatgctcctgctttaaccaacttatatgattattagaagaaggaaatggtccgcacatttccaggatttcctcaaaatgcctccgtgccactttgctcatttggcgatcctgctaaatctcttaaacctcgagtgctaacgatatcaattccaaatgatgacaataattagctcgaggcacgtcctgatgatatactgtaaaataaaataatcctgcccggaatgacgccagccaggcttcaagagggggattattagttgggaaagcggccaaaagacctaatgggtacgatcagattcttcatgtctgctttccaacatcatcaccaacttcgctttaaccttaagcaattcttccagctagcagaactaaagagctcttttcctaaataatataaaaaaaaaaaattacataaataatttaaaatctaatttttttatcaaaataatgtaaaagagaaaaacgtcattttgaatgacgttttttccctgccacgtcacccctttttttttcacaatggcatcgtccgaaaaaaaaaaaaaaaaaaaaacaccatttaaaatgatatttttaaaaacgccaatcaaaatggcgttttttatttttttcatcaaaaaaaaagaaaaaaatcgagaaagaatgggaaaaaaataatttttaaaattttaaattattattaaattaaaattttaattttaattaaaatttaaaatataaaaatttgaatttgtaattcaaataaaaaaattattttagacgatttttttttgaattattttttttaaaaaaatatctaaaaaaatattaaaatattaaaatattataaatattataaaaaaagaaagaaatgcgaaagaaataaaaattttaaatttaattgaaaaatatcatttcaaattcttgtcaaaaaaattcaaaaaaaaatttaaaaaataaaaagtgccattaaaaaatcaaaattttaaaaaaattgaaaaaaataagaattataatttgaaatttaaaagaaataaaatttttaaaattaattgaaacaaaaatatcatttcaaattactttctcaaattaaaattaatttatttaaaaaaattcgaaaaaataaaaaaatagcctaaaaaaatttcataaaaatagaaagaaatgtaaaaaatagaaaaattatataattataaattttaattaaaaaattaatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggacaacgtaatttgaaattatattttttatttgaattaaagttaaaattcttatttttttaaaatttaatttacaaatttctttttttcacattttttcctcattttttcactttttttatgcatttttttttatcaaattttacttcaaattaaaattttatttttttttattcaaatttgtaattatataatttttttatttttttcatttctttctatttttataaaaatttttatgctattttttttatttctttcgaatattttttaaataaattaatttgaatttgagaaagtaatttgaaatgatatttttattttaattaattttaaaaattttatttttttaaattttaaattataattcctaatttttttcaattttttaaaaattttaattttttaataacactttgtattttttaaaaaattatttttttgaatttttttggcaagaatttgaaatgacgtttttgaattaaatttaaatttttaattttttaaaattcaaatttataatttttatttctttcgcatttctttctctttttttcctttttctatgatattttttattttttaaattttaaggttttttagatattttttaaaaaaattaatttgaaaaaaaaaaattcatctaaaattatcttttttatttgaattatatattcaaatttttatattttaaatttcattcaaaattaaaattttaatttttttattaatttataatttaaaaatttatttttttctcattattttctgatttttttcttttttttggagataaaaataagaaacgtcattttgaatggtatttttaaaaatacaattcaaaatgacgttttttaaaatatcattcaaaatgacgtttttaagttgtatttttttttttttccgaacggtgccaatgtggaaaaaaaaattaagtgacgtgacaggaagaaaacgctattcaaaatgatttttttttttatattattttgataaaaaattaaattttaaattatttatataatttttttttatattatttaagaaaagagctccggaactaaagcatgggcagaccaattgcgataatctttgaaaaaataatgtttgatccattcccaaaaagagagtgcgtcatctgacatccttttctttttatcccatacaccatcttccgtggcagctttcgctgggaatctacagcagaagagaatgaaccttgctcttgtcgttgtacggtaacggtctgattcgaagcacacgcctgcttataaaatccggagatgctcgagcaaatcattacaaacaaatattgtatcggtccttgtccgtcagcaggcattagtttaccataatccaagcacaccgacgctaactctttagattcttcctcagtgctgattgtttcttccgcatggcttttacggattcttgttccaaaccatcgttctctccatatctcgctagcaaataaattttaggccatcagacgaactgtgtttatctgataaaccatcaaggaactggatgtttcatctcaaactcatttcggtctggatcaaggcactaccggtgataccccactaatgaagccccaaaagcaatgattttttattgaaatcatattcgccatgttaggagttcttccatggcctcatcctgttaggatatcttaccttttttcctttgaataaaatgctaggacatctttctcatcgattcaaactgctgctggtagtgaatcactaaatttgtgagggctctatctcttccataataggcattaggtttgcatatagaagaaatattgggaactccttcaaagtaaatggttctatacgtggcttcaaattcttgcacttcagatcttcagtcaggcaatcggattattttttccaaaagaaaaagagaaagatcaccaagtccgacgcgacacaccttcttctgtgtttgcaaaagctatccaaactggagtagaggtgattcacgagatacttgcataagatcctacaagttgagcacatttaaaaaatgatattttagaaggaacaagtgaagtcttgatttatttattccttgatatactgcagatttatatgcacactaacagatacatgtaaatgcaaaaggaaaaaagaaaaaaaaatgaaaactaattcagcaataagctagcaatcatgactcatgacagtcattcaatcaaccagattaggtaaattaagtcaaatatacagcctatcctcttctgctatttctcaacttggtgacgttagcatgctccaccaaaagaaccaatgtcaccatgcactacacactactacacgttgaagccgcacttctttgtgctcctcaagagtgagaaatattagatccatggcagaactatgtgtaaaatgtataaccctttttataccatgctcatttgcatgtaaatgcaggcatgagatagtttttttcagcttaatatgaaataataggcatggcttttttacaaagaactaacaatcagataatggtagcatccagtagatggctaagaaagctaaaatccaggattttgcatccacttcagaaaaagcaggtggagagaagaataagcagtttttcatatataaggtgcacatcacgactttacagccaaaataaacaacagaaaaaaatactcccatatagataaacgaataatgtaataaagcaaaaacaaaaaagctcatggaatcccataaaagagggcaatcgtgtaaaacagaggatcccacacccatggtcaatttccccacaaacaagcaaaaagacccttacagtaatacgtccacataggaaaagccaaggagctgcgggatgtcagtacatatgaccaggttgatccactcacagcttttcagcactgacatgtttccatagacatctagctgaacctaacaacaatatcactaaagctgttagaatgcctggatatctgtttaaagttgccccacacatgtgaaattttttcagtcgtaatgacaaacaatcactaaagccaaaatagaaagcccacatttatgttcaaatttaccatacattctaaattttataaaagcaagaccagaacaaatcactggaacgacaagcagattcacatgtttcgcaatctatgatcatttcaagtaacagcaaatagaattactcatggtgtgaaacatcaacttaaccatccttccagaaggggcaaaactcgagcatccgttagaaccagagcctcaactcttgcacagtcaagttagtcatacttttgccagtaaagaagtgccctttttcttttcccttttatctctcctgattgattgtgttgtcgcaagcctggatagtgacatagaagttggctcgagagaggcacaagtcaaaaaatacaaagtcaaacaatgtgacggcagtaacccatcttccaagcagacaggtttgcacgcaactagtacagcaagaagagggctctagagatatccagaatataccagcacagtgaaagaaccctttttctcaaaatcattcaaggtagctctaaatttacttcagaatacattcagtatagcattatcatacaattttaaacataaaattattgctgtgtatcactactattaaaacatttggcgttttgaacgcaaatttgtcttatagcttatttttccactgaacaaaaaatgtgatgtgctggctcccctgtttttaaacaaattcataggctcacggacttaaaattttacaatctgtttgttgtaatgcttgtggaagtcaataagcaatttacaattatctcctcggacaactagtatgaataagctgagaacagaggaaatcgaaggggtcaaaaaaagagatgtatgtgacatcatctgatcagaactatgtagagaagagtgatttgatattatatggatggttcatttacataaattgacaagttgcggaaagattggaggacaattgttgaaggaacaagaagcaaaagataagcttacttttgagcatagcaggctctccaaaatatataaccaaatagatgaaaaaaggcatttagtttgtaagaacggggaaaagatacagtgaagtctccctccacactttctgaacaagaatttggtgtctcaggtgaataaatacaacctctacccaccaaaaatggattggaatctcaccaattaaataagcgggttcttgctggtaggtaaacaaaatcctaagggcctgttctttgaaaggtaaaaaaattatccggaaatctgtgttttttttttggataagtgcttcatgggcaatatttaaataagaaaataaattacttattgatgctaaaccaaaacaaaagaagaagaggaagaagataagtagcagaataaagataagagaagaaatttagaatagacaatcaaagaagataggtagaaaattctataaattatttcaattctcaatcaatcaaaatatgcgaataacgtcttacaagcccatatttatagacttacaattctacagttggaaaataacaaaattaagcaacacatcttaacaaaataagaaaatatgcaaaataaatatagaatctcgtaaataaaaaaaatcaaaataaatcaaattagcaaattaaaaaaattctaatcaaatcaagatttcaaatcaaatcagtaatttaaaaaaattctaatcaaatctgaatttgcatctaaagagtctagaaaaattaggatatctcaaaacgggtgcctcaattatcttttacttgatcttcctaaagtttgtgcatgcagcgtcagtccatttgaactcttaatttttcatgctatcagtaatggaagccctaatagtattaaaactcttaatgaattacctataaaaggtaaccgactcatgaaaactacgaacctcagaaagattctctgattcgggccactttctaatagctcttactttttcgggatcaactgaaataccttgcaccatgacaatgaatcttaagaaaagaatctgggtctagatgaaagagcattttttgagattgacatataacttctctgctcttaatgtcaaaaaaatctaacaaatgtgactcaatttttttatacatgttcttttgcattactttcccggataagctactaagatctattcatatttttcataacatcctttattatataaatattattatatattacattatactatattatattatattacacggataatacaatatatcataatatataatttaatatagatattatattatatcatattatattatgattatgatattattattattttatattatattatatgatgatgatgttgatatcatacttatataaaatagtatataataatactatatattatattatttttatttttatattattatactagagttaggggtatttaaagaataaaataaaatgattattgttttggttgatggaaaaatgacttatcccccttttagatggataagacttttctcttatttcatacgtgaatattgtagaaaagcaccacacacttagacttggatagtgggctatgcttagcacggcatgatccaggcctgccaagccgctgtcttaatgggccgtgtctggcatagtccgtttactaaatgggccatcctaggcacggcacatttaacccaacctcctaactcgacttggcccgtggcccagggtgtggcgggccgtgccaagcacggcacggcacgtgaccagcatggcctgttggacccaccaacagccataaatggtctttttttatatttttatcatcttacccatcttttcccaacagtcataaaatggctaatttgaaggataatttggaaaagtaaaaatatatacaattttatctcccaaaaaatcataaaataactagttttaggagtactttaggaaagtaaacatatttggatttctataaatacaacatccgatgatgacgatacaaacactactgacgattagtaagatttttattttttattttttatttttataattatactttttaattttttaattgttgaggtgagtcacctctatttcttctctctcccatattgtattctagaggtcagacctagctccccttcctctcttgtactattttgatttttattaataaatcggtagggattcacactaaacctcccacaattacaaagtaactttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgactccgctcaacactcatctattcatgcatggtcagatgctgcttagataaggatttttatcctatatattttttttaaattggactaatcatattcatcaatatcttattttagaagttcaaatatatttaaataataaatagtttaataaaattttaagataaattaaaaaatattatatatatataaggacatccaaagcgtgtatcgggatgcccgatcaggatggccatcgggatgggatgggatgcggggcatcccattccaggagaaaaccaagacactcctgacccataggatttaaaattttagccgcaaacttacaatatctcatcccacttctactaagcatatctaaaacatatgtttattgtgataggaatatagtgtctcttactttgtctaccactacacccaaatagtatttcaactctccaagatccttcatctggaaagtttgcaacaaataatccttcacgacgttgacatattcctgagatgatccggtgataacaatatcatcaacatatataagcaatatagtaattccatgagtacctgtatgaacgaatagaaagtaatccatctgagtgcactgaaatccaaagctacgaatctcatcaaaaaacctctagaaccaagccctggaggtaattgctttagcccatacaacgatctcaagagcctgcatactttcctaccaagatcatctacagcatatcctgatggttgctccatatatacctctttctttaaatctctattgagaaatgcattttttacatccatctaatgcagatgccaaccatgagtaacagcaagagcaagaatatgtctgatagtttccatcttgacgattgggctaaaagtttcattataatctaatccatactcttggatgtatccctttactaccaatctagccttatatctctcaacactcctatcggcttgtcttttaattttgtagatctatttgcaaccgacaacattcttttcagtaggtctatccatgatctcctatatatagttttcattcagggcagccatctcttcatttattgcctctatccatcgatggtccttgaaagcttgcttgtaagaaatcggttcatgctcatgctggagtgcaaaaagatatggatgatactcaatactaaatacttcatataagacccatctatcaattggatgtctctctctgctagaacactgtaaaactgtctctaaaataggctccttctaaatgtcaggtggagtgtgaagtcgctgctcttgctgctcacccatctcattttcaagtctggcatagtctccttcagtagtactcatcagaacatgcctatgataaacttatctatacattatatcttccctatgctgcatggcaccaatattaatgggtagaaagtctgtccttacagcaacttcatgcctatcgcagtgatcgtagtcaacttctgtaatctgcatttatctcaatgcatcatcaaatcatggctggaagctgacacaatcattatctatatagagatagtcatttccttcacatgtatagtagggcactgctcatcatctaaacaaaaattattttcatcaaatatgatattccttgaaatgataatgctccatttttggagattgcaacaacgataattcttgaagtcatcagcatatccaacaaacctacaaacatcagtcttaggagcaaacttagttctttgaatgtcagaactatgaacataacacctacatccccgtacttttatatagtcatacatggaaaccacagcatgaaaaatttcatatgatgacttatgccccaaaaactttataggcagtctattgatgatatggaccgctgtatgaaaagcttcagtccataatccaaaatgggcacaactcccatgcatcatgcttataccactctcaactatatgccgatgttttcactccactataattctttctgacgtctgtgggcaagacttctgatgatgtatgccatgactatgtagataattcttaaattagtgaaaaatatactccccacccccatcactatagaagttagtaataggcatcccatacttattttggatgaaaaatgaaaatgctgaaatatggatgaaagaatgaaaatgcttgaattgggctaggtccccacatatttgagtagacaatttccaaagaaaaagaaactcatttatttattatctgaaaagagagaaaatgactcttacaaatttgacattctggacataataattcattaagtgaatctttattacatgggacataggagaaaagacctttcttgaatatgaactctaagaagtgaataccacaataagtaaagcatcgatgccacaatctggcatcccctttcttggtattgacagtactaaatagtaatgaggatggctttagactgatattagacttagatgaataactatgagcttccttcaacacaaacaagctcccctcgcgaacaccttcagcgagtgttttgttcgttcagagatctttgacaaaaatagaatcaggagtaaaaacaacataagaatctaattaatcacataattgaaaaatagaaagaagacccttttgaataccaagaactaaaaatatgttggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcatttggatgattatgctctttataatttgtatatgaattataaattaataaaaattatttgatatttttcatcataaggtgtacatctttcttgatcgaattctaatattgtgataaagttcttagaactatataacaattgataaagaaagatttatcgaatagttcttaaatatattcacgaccaaatgatacatcattaaaggacgatgacgtttatcgagtgtaggtcattgtgtgccatataaattgattgtcctcgtaaccaagaagtgtgaagatactggtatggcatacagatgaaatatataagtacatcattacggaataagtgactcacctgtggagcactctactgctaaaagtagctcacgaagaatatggacataagtatcccttcgacctgagatcaccacagtgacttgcaagcaactcactgtgctttgatatcggactatctgaatttttaattcagtgatgaaaaatttttaggtacaatcaagtacttgtggtagtcagtgtgtggatcaagatgggattgacccctccgtatttcaaaagttaatgcatcactatattttaattaagtaagatccgatcggagcaatccatgtgataggtcacaggatttgaaacctgatccttgctatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacccttgattagagaaaaaatctctctctgaaaagaaaagtaccatcaatctttggagtaaggatacctcttgatggttgaaaaagagcggaagagatcaatggatggctggacactgaccataatacaaaggatcaaaaaatttactacaaacctaaaagagttcggaacaatggcacaaaaagataaaccatagaaatgaaagagagcaagaatgagaggatgaacaagaaaccttaagcccacccaaagtgcctcctcatacacggcaagccaatcagggggcgagttatctatacatttgtttgccttacgaagttcaatatcaaaatctaagagaatcccatatcaaacttgtatctgactcagaccgtccggattcaacacagagctataaccactaggacctagcttactctgctcgaccattctcaaacaaaagggctaaaaggatatctaatgaaaggaaggaagaacagaaaaatagatggacaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtatctctcaattcgatcggctgctgctggttatgcaaattgatgccataattcaaaaaataaaaattaaaatgacttctatttaatttcgccatgatgatcaagtcatgctgcctcactgtcgccccaaaagtcatgcacatcccatcaattaatgggcttttttgcatcctcgacctaggaaagataaatatactccattcatccgactaaagtcaaactcaagagtaggagaacatgtgttgaaaaaaattctgcatggatcgaatatataaaaagacctaggtctaagatgtccgcgcttagcaagcccatcaattgaagccttcacccactcaagattgactacaacttttgtcgagctaatcctttgcaactacctaatcggcgctttactttctgagcagacgagagtcccgttgatagctactcggcaaaccttgtacattatcgccgacgatcccttgtcggtcgaccaattatatatcattaaataaattttgatgacagaatggggtgcccgactactagtcgccgccaaccaatcctcatctcaataaccttcagttagcaattttattcaaaatacaacatctatcaggcaataactgtctctaaactgataaggcaatcacaaccaccgcatcccgaaaatcttgagcgacaattttgtgccccatgaattacgttctgaccacgcgggaccatgccaaccacttgctaattgaagctccaactttccgttataaaggagactcaaagaggaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacatagctaaaatcaagtcgattgaatttgaatttaaatccgattagatcaaaaactctgtattaggggtcctatatcaatgatccgagtcattgaatatgatctattatctcataattgtttgcataaaaaaaattatttgattcgaagatctctatcctatacatcaagtagtcaaaattggacaacctaaataaaattgaattaaacgtattttttgatcgcttgatgcatatgctaaggatcttcaagtcacatcattttttatatgtaaatagttttgagattatagattacatccaacggcttggatcatcaatgtaggaccttcgttatccagttttgatctaactggatctgagcccaaatccgatcgatattatccaagtccgtctctatatatatctataaattagtttagtttaaattaattttttaaaaatttaaatcaaaatcaaatcaattttttaaatttctaaattttttaagtgaaatttaaaatttttgatctaaaataaaatgcaattaatggttcagatcaattttaagatttaatcaatttaattgcgcactcctgtagttggccgaccagactcgaaagccggtctagcccagcagccaacaatcaattgccttggttcaataaattctctcaacaatcaatcaaaagcttccgaagaggaggattcggggaagcggctcctggttttgtaaccgctggtcggaccgcctgacgcttctagatgcgtcccccctcgcccccaactctctctttctctgcgtctcccacgcacacgctttatttctttcttggcaacaaagaaagggagagaagagagagagagagggagggagcaaaaaataaagggagagtgaaggaatactgtttagttgttcgttcggttggtattcagacgaagaaggaggaggaggattaggagatagagaggtatggatggttatgggcgacaaagaggaggaagggtgtcgcgtgggctgctgccgctgctggcgatgcacgtggccaacgagtacttccgcctggagcggaagccgcccgtcacagctgggctcctctttgccaacaccctcatctacctccgcccgggccccctcaaccgcctcctccccaccatcgacgaggtctggttcaatccccacctcatcatcaaggttcgattccctgccccccccttccccaatatccctgatgttgatttcttgtgtcgttccatatctcccaagaaatgaataagctattcacggattttagtggatcaaatctcacaagccgtttctctttctcgctctcgcttctgattgggttatctaactagcaattttccgtaggctataaaacctgtttaataattgataatctttttctttttttctttttccttttttttttggaggaaaagggaacctctttaatactcacatagaaaaattaaacacttcatgaagttggagaaatcataaagctaaaatgtttacacggatttgttgttagcaacttgtttctttttccaaaaattggagaaataattattccttgaagattctgtttcctagagtaatgaagtggttatatcagtatcggtattcgctgggttatgttcacgaacatatgaaattgaagctttaggtatgcaacatatgatcttaaaacaatccagaagattctttcgatgatgttcgaaaagttcaccaagattatatattttatgatgcaaaatgtgtaagctttttcctagaggggtcgtgcgcattttacttggtttatttccccttggattcatgagatttcagttgacatatattgctagtatgataatataaaaaccgtaagaaccacctttttcctccttccaaaccccaagtgcaattacccggtacatgggccttgtgggctatttcaatccaaggcatatacaaaaaccataggaatataatgtctaccaaacaggaaaacctcaatttaatggcagcaatccaagggatatgcttcaatttccccccttttcttttgcaaaaaggagccacatgtatctcacatgtcaagcctcaatgagaaggaaatggtgcctcttttttctgcaattatggccccgttgcctctcctttgagctccacctttggtcaacagctatgcatgaccagcctcttgcattgtgatatatgaagagtgccaacatgaccatcctctgcttaagtaccaactttggctacataagcatccccattggtaaagatctgaaccaacaccatgctcaagggaatggtaatgctctcaatgttcccttgttccccatctttcctctcaagaaagaaggggatataatgagaaagacaggaaaacatgaaaattggagggttcacatgagggaaactagaagttacaaagcattggtagataatggggagagcgtaagagtttgcaacgtagtggttatgtttacaagagaggattccttgagataacatggtttatttggaggtttgttacatattttatggaggggcggaggtggttgggggtgggggggatttgagcacccgctaggaagtccttatgtgaaaccttttaagattatgtgaaaggaggagagaatttgtgactattggttgcatgcatgggagtcttccatggatgagatgggattgaaaatctcttcaagtgggactcttttgacttggttagcttgtactgatataggtgagtatattttaaaaatagttttgatttaattattttgtgggtccagggaacaaattcttggacagcaattatgttgtctaggagtttaagtgattaagtccatgaagggtagatggatccctaacttcaaggacgtgggtattttgaaagtggccaatccaatgggccattgtgctcttaggctttatctccattgcctaactgcatgtgatggagtctggagaggaatgttcttcctttgaaatcttatcgtgttctgcatatgaaggttgggcacttgaaaaatggtttcattgccaaattggtgaagccggaatccacccaacctcacccaaataggattggagctctccaagagttatgatgagtgctagaacacaaagtatattatttgggagaaagggaagaagcatgcttgcatcataataactagattccaatgcttgagaatgcaccatctaagcttgtaacctagaatctcttattgctaggcagaggggtaggaacactaggacatgtccaggcttatacagctcctaagtatatttgaccatgcacatgtctgcaccttcaaaggaaagaaacctgacaagattttttgataaagatgggactcaattaatctggtcaattactataactttttctagaaggaaactcctcatatgaatgatccgctgatgtcccagaaaatattaaatcggccatcttagaacttgaatttcagaggagaaaatagcaataatctgaaagcctaccacttggtgaaccaccattcttgattccaacactttgaatgaagtatactgcctgtattatacttgtccaacatgacgctgtatacattttatatggtgtgttctttgggctgtatgatctggctagcagcttatgtgtatcatggatggttagcttacttgtgcaataattaccctagagatttcctcatccttgccaaaacataagcactcaatcatctttccattttcattttgttattttaaaaattatggtaggagtttcaataatcattcattataaaagaaaatacacatgtcaaatacttgtagacaaaccaaatgttgaaggataaagcttgcatgtcagataagaaaggtgcaaatactgggctgtagccctataaaaagatgttgcattggcatgcatcgtggatttttctgcaaaggctgggatgttcaaactaaactgtgtcatgttgggacttcattttttgttttagtttaaagactttggcagtgatgcgactgatagaaaggaaatggtggaaaggaggaagcataagagtatgtttttcctgttgctattcctgacattttcatccataagtcctataaaaatcggattttcaacaacctaagtcattaaataaaaaaatgatccctgtttaatctttgcgatccagtgtaatccaattgattgcaagcaccaaagattattttcctttgtattcactatgttacaaggagctaagttctattaaatttgctttttttaagatgaattcttgtaaagttattgttgggttgtcctcaattagaggaagagcaagttgggttttctgtaatggccagtgctggcaatttaattgagtaacctactttgattgggtttagtgcgtacatgagtatttagaaagaagtgttagagtggtataactatctcctgaggtatgggattcaggtcccacatctgtacttatgctctgctgtgtcgacatgattacatcaggctatcatgccaagtcttaagtatattgtaggtagtggggacttctccctcaagtcaagtttatgtgacctaagttggaactcatagcagtagtgggaaattagaagtcatctacattgtgtttttgggaaagaattgatgcactacaagcttgttagcatgattagtaaacttatggtccttctccatgttcatgtgttggtcaatcacctttagtctaaaatctggtcctgtttcatgcctaagcaattgcccagttagaactggaagcctttaggctaggaactaggtgttcattttgctaatatccaattgactggagctaggctaattgtaagcaagttggagaagtgggattagaattttagccaattggaatagtgatagaaagaaaccaagtctggaaggtttcaattcgggttttaggggcacttatttcttatgtcctaagcatgctggaaaaagagtggttgacatttttgattaagcagtgtgggaggagatctgcagctagaagcaacggttttggttgtcatagtacagctcttggcaagttgccacttagatgggggcattggaccctgtttatctaacagtggtttcgcctctatttgttaacatagactttgggagaccattgtatctctgtccttttgtttcattgggaaaatgcatattatttgatacctggttctctgtaaaaaattagagacttgtcagatgatgtttctctttcccaattattggcgtggttgggggggagaaaatggttgtgtcattttgctttatcttttgtgcttcttgcttgtggatcttttgtggttgaggcagtttttattactatctggctgattctatgactcatccactgtttgaattttggctggtcttcttatttagtaaagagagcatcaatttatatagtcaagatacaaaaaagtctagaaggttctttgtgtttcttatcttcaattctaagatttccttcctctgccccaaaaggatttctatcacatatagttgtgaacaaataaagtttgaattggtagcggagggcataacctgtgctgattgaatgaattttaaggacaaatgtttatcatgggctgtcaacctgttctatgttatgctgggtgcttaaaattatgcagaataataatctatttgccatgcagtctgaaatatattgcagagtgattagcatgggtgatatgcaaccagatcatgtttagattcagtgagtgattcacgtataccggctgcatatgtagcaatcagattgtttgaaagagtttaacgagtcaattgcaagtagtgatgaaaattttcaaaattactgatttgtcgaaatatatttttttgagtttataaaacaaaagatcatgttgatatgaggacattcgtggtttgaaagttaagaaaatctgtcctaatgatttcagtttgaacagattctgttgactctagcatcaatttaatgacttgctagtattttaagcagattgtgaagtaatgctattttcctgtctttctgaaggtagaaacacaaaaatgcattttcgttcctttgatcatgttatgtagtctaatttctgaatgaattattcatctatctgtgtcacccgcagcatctcttcatctttcagttatcatccacattcattttcaatttttttccctatcacactaagggtgaattttcttttactaacttagggtctttaatactgtcctaagcagtatggggacctgaagcgctttttcctgtcagctttctatcatatgggtgaatcccatttggtctacaacatgctgtctcttctgtggaaggggattcagctggagacctcgatgggcagtattgagtttgcatctatggtagcagcattgcttggcttgtcccaaggcatcacccttcttctggctaaaagcttactacttttctttgactataggaacgcatactatcaccagtatgcagttggattttctggtgttctatttgccatgaaggttgtgctgaatgcccagtctgatgactatgcttatgtgcatgggatgattatccctgcacgccatgctgcatgggctgagttgattctcatccagctatttgtaccaggtgtgtctttcttgggtcaccttggtgggatacttgcaggacttctgtatctccggctgagaggttcatattcaggccctgatccagtcactgctatgattaggaatgtcgcccgaattgtaagctggcctttaaggtttgtccgtggcttgtttggattccagcgccaccgcatatctggaagggggaggattggacgcagtccaccaaggggagctgtgtctggtgtgtggagatgcccggtatgtacttatgacaattcagcatcggtggatgtctgtgagatgtgcaacacaatacgtaggggtaatgggttcggcctgatgcgcacacctgatcgaaccagtgacctctcagtggaagagctccgtcgccgtaggcttgaaaggtttgatagatgattccacaggttggtgctgataaacgctggcttctttcagaatttgttgtatctcaaggagttcatggctagtggctgttgaagaccttaagaaatggaattagatgttggaaatgcaggggaatttgttttgctgtattcatagatcaaagaatcacatttggatttccttgaacttcaacgaagaaatgaaaacaaggaaagcattctgttggaacttagctgtgattttttagttagaattgatttattagactgcacttctaacttcttttcatattgcttcattttgccaactgttgcattcattgcttgcattcacttggaatccagcactttttcgtaccacaagaaattttaccgcccaccactaaaatacgacgcctggaggatctctcgccttctgggaggaatgacttgtggttataatcatttctatattcaaaaaatcataagcagcaatctgcatgctaattttctgatttgaaataactttacaagatttttatgagagatctttgtattttctgttataatgcatcgctgtgcaaaatatgttgattccggtagagagatcttttcattgtatgagcatttggaatgtgtgcatattaatgacggtgattatcagaccgatatcttatcgtaacagtcattatatttacatggaaacgatattacaaattctgaagtacgtgccagcaaaaaaaaatatatttttcttaattagatgaacggtactgcaaataaataactagtaactatgtcgtctttctatgttctcagaaagttatattatccatctaatgctgctgctctgttgtcgcttatcatgaaggcatacaacgactgtcgtagaacctgttgttttatcatcacataaacctagcaatggtatgaaatgtaaaacgctggtctcgagttttgttgtagcagcaagtaacaatattggatggtacccactgggtggatacagtgtccatggacatcatcgaaacgttgattatatgcgaagccatttatgacatggacttagagtaaaatggtttaatgtagttattagattgactgggagaaagtaattcaactttgtcgaatcccttggagtttttcatttctatgtttatgttctttgcctttctttttgagaaccactgagctacttgctcaggtattctgtttttcttttataatgtgcgcttccaagattctgagtcacattccaaaagctttgtaatcttagggacgttggttttgtggttttatttatatacccctacggtttgtcaatttctttctttttctaattttttaacgtacacgtgcgtggcgctcatctgaaccgttgatgtggatccaaagattattattatatcctctcacattaagtcactcctctcatttgattcattctcatatatatagagagtgtctcaagtgagaagagtgacttaatgtaagaggtgagaggatataataataatttttggattcacattaacagttcaaatgagaatgcggttgtccaaactgtccaaatattcttaggatttatctattccttctttttctaattttttttaatacgcatgcatcagcgtgcatggcgttcatctgaatcattaatgtagatccaaatgttattattatgttctctcacctctcacattaagtcactcctctcacttgatacgctccctatatatatatatgtgtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaaactcttttcaatggattggaataattttactctaactcaacgagtattgtcaatcttgaacaaccctagtgaactttcataatccactagtgatacctaacagtatgtagtggcaatccaacagaaccgaaaaagaacctcaaagtgtagttctcatgtgattcagtccctctatcatgagtcccaacttgatggcagatcatagataaatcgtcaaacctcatcattagtcatatgatagattcgattagcttaagtccaattgtgattatcataaaaaaaattttcatcaatcacacagctgtggccacagacttatggacttagcctctcaaatcctatagaactactcttttctatcaagatcaataaatttcatctagatatgcatcttactcctacactggaccaactgtcgtcaacatccactacaaaatctcaaagagaccatatttctatatcaatcaaacttcagtagtcttacaataagcaaccataccatcacagatcaaagaatcattcacacaactacagtatcgagatgatcactgatgattgagtagaaatctacgtgatctcttatatggtcacactcagtactaattattctctaacaactatccacacttgttgctcaatatctctacactatagatcagagactcatctattctgaaggaagcgatctgtgcgtcggtctatctggatcgatcggcattctcataatgatactataatcagaagtaatttaaaaattaattatacatgcctataattctcaacatcttgagaatatgtatggtaagtattaattttatggacgattcaaggatacatcacacttgaatgaaaataaacttatcattttattgatcaaatcaatattttaaatacaaaattatgtcttagtgttattataatgtgtcagctatattggcttctagaacatacatccaacaatatagtgtttaggttgttatatatattcatagaaagttatataaggcattaagaagtcatatatatttatttaaaatattatataaagacacagaaagtcataatatttttctatctttgttctataaagatatttttttcaacaaaaatctgactcaaaaaagttgagcagcattaaatgtctatcttattattaattacgctacatagtccaatttgatttgacagtgtgctccacatcaatttgctataccacacgtagtgtacaaagaattactcttgggtaactagatggatgggtgagttacaagctcttgggatctacggatcaaaatatttggattcactcgagaggattttgttcctatagaattaatgctgggggtctagctacttaatcatttgattcttttgctgcatcagacgataaggcattctatcttacaagagctgctggtatttacttgtgaattatagttatatatgttagatctcaaccttatagaaaagatcataagtgctttaaaaaaattctttcgcatattaaaattttatgaaaaaaatgtataaaaaatatgctggtgccaattagagatttttgtagagttaattatgctaacagacattgcatattctattcaaaaagaaaaaggaaaaaaaaacttctcaggagatgatcatatggacacgatattgataagcaaaatagaaggaattgtaaaaaaaggataagtacaatgaatgcattacaaggagatgacaagtcaacaaataatgaattgaacattctactgcttttcaatacaaaattatcaagatattacaagctatcaaaaatattgattatggctatgatgaaatatttatattagccaaataattaatagaaattatatacttttttaggtagtcatgtagatagcagaaatgaccattcttacaactaagtaaatatgctcgtgctttttttttctattttaaaattctcaaactattcttagcatacacttataaagttttacttattcctaaaatatatttataaaattatgttttactaaatctaaaatgtatccccaatatttccttctttttcactatattcctaaactatgtttattgttcatggcagatgaacctatatttataacagacataccaacttatagctaagtttattatgctaaaagatataaatatagagtgctacaaaggaaggaaaaaaaaagaaaaagatgactacaaagggtggagtggtttgctttgaaacatatacttatcttcttactctattttaagcactaaatttgaattattcttttttttttggtagaaggtggcttgaaggctatattaatacataaaaaaaatttacagagcttgttctttataggagaaggcaaaagcaggagcaaaagctgaggcatggaacaattaaataaaaggttatatatgtacaaacaattacagacccaaatctcagaagtattcagataaagtcttatagaccccaatctatataaaaggcgtgaagaaatgttgtagtctgaagcagtgaggtgcagttgagtaagaccaagaataagcagctgaagaaccataaaacaaaaggatagaaccacttctttgtgtagagagttaccataattgtgaatagtacaacatataatattgttgttgccttgtctttgaagctccctagaaaacctcttgcatccgtactagcccctgctaaaggcccaaactgatgcatatcatgaatagttcgcccatatatatggttgcataatcaaagaagagggggtgagggatattaatagcaatctgtgtctcttggaatgagtaatagtttaaaaatgacgtgaagaaaaatacaatctgtctccttaaattctcaaggctaagagaaaacagtccattgtagatgcacctgaaataaagaggctactgttgaaaataaggaagccttgctgttgttgctttagctgaaggagaccacccaaaaactagtggagagaatgtgaagcatcatcagcaccgagtatatagaaaatttggagctgtgaatcttgtgagagcgtttagtaaattggttatttgagtagaaaaaaatagtaatcagccttaccacccttccacaaaattcttcatactactctatggcaaagaaaaattgaagtttagaatttgattatagtttgatatcatactgaaaatgaaacccatatatatctaaagccaacaagcagttctgcagtgcatagagaaatcaatatccacagaggcaaaggatataaagacatgcttttaagtgcaactggttatgatagtaagcatgagcctagcatagaatatgtagtgaaaacatgatgagtaaaaaaaaaatccagcatctgaaaagatggccatacaattgaaacatgcaattagcatgctctaattgtttttaagcataaattgtaaatgttgaaaggcaacgagttaggaagcgtagttgaaatgcctgaaagtccttgatccctagcactaaatggatgataaagagaagtataattgatgttgcataagaatatcaaagtaggacaagttataatagattggtatgagtcactatacacaaaaaaagagcaacatgcatccacgtaactaaaatgatttacagcaacaagaataagatgaagtagtaattctaactttaagcatgccttggataagctaggccataagcatcagtgtccagtatatgtgctaaactagagcgtggatgagtcatgtgggaaaagaaaaaaatctccattgaagcatgatttgcaagccaatccgttgcttgattggcctctctataaatatgtgaaattttgacaatggaaagtaaactaatccatatttgaatgtcttaaaaccaaggagattgaggtaatttagaggcaactctattatttaaccaagagactataatagaagaatcaccttgcagccaaactctttggagatggaagaatgaaatgagagcctgtaaaccaagccaggcagctataagcttcacgtaaggtacagagcaagatagaaaaagtttgccccctagtctaagaagggctccatcatgatttcaaataatgaaactagcagcttctttatgcttctgaactataccattaaagtttttaccaacacccaaaaaggagggggcacccaataaataagattacgatacaagggttgctgagaattcagcatagggatatcgccagttctttgactgggcattagtgatagagtgacaatagaattgactttgcagaaggagatacatagctgcataacattatcttgagtagtatgaatattttggaagagatgcctattatggacatcccaaatgagagcagccatatagacaattactgctttcaatagcttctggacatgaggattagccaagaaatcaaatagagtagaaagggaggttagttgaaatgctataaaaaagcgagctaatgctgactagcactcttgggcataagtgtaggtgataatagaatgcttagagtcatcttgaacatcctgacacaagccacaagcaatgacagtatttggaacaacacctctagaagcttagagctgtttgcaaggcaagccatgcctttataatttctagcaaaaacatttgatccacatgggaactagaaggttgcagacggacataacattatgtggttgctaagtagtggtatcatattgaagagctgaggagatgtctctaagattgattttggaagatcgagagtgagctcaaccaagctgatcagaccaatctccctatgctaggggcaatgataagatagtagtcatcatcttagcattaaaaatccgatcaagagcagtcctatcccaagtatggtttgaagtaataaaccgaaccactgaataatgctagaggtcaactgtaacattagataaagagggccaatgtgataaaggaatgggcgccagacatggatcattccaaacataaatagattgcccatgagcaatgagccatataaattgatattgaattcttttccccataatgcatatcttatgttgaatgagagaacaacaaacatgcttctgatatgtctaccaaaagcctaaaaatttatatttggaagaaacaaattgagcccatgaagaatgaagttgaagaactaaattagcagcaagttttgaccgcaaaatttgttgaataagcttgagaaagcatagtccaaatccatctttagctttaggggtgcatatagtctccaagcaatgggatagaatcgatgctgatgggaagggaggcctcaaaaaaagatcttaaattcacattcgatagagttgagcactgtaagcggtattggcacagaaggcattgcatagagaggtataaaacaaagaacagattgtaagtgaattaatcgaccagcaaacaaaagaatacaccactttcatcctgcaagttttgcaaagattttttcaatgaggaaagtgaaatctacagcattgagcttagttctgaaaatagagacaccaagatacctccaaacacttgatttccaatgcatatgaaagatggaagagatgacatgtttgtcctcagaagtggtggatgggctatatataaagtaagatttggaatctgtttcctcccttatacaacattaacatccatttttctaagctatacatattttgattctattgactattgctacacatatcttcaatcttggtacactacatagaccttattgttggttttttcctattttactacatcagatgctatacttactgctaacctttaatttgtcctcatctcttcaaatgccgcaaatgacttagacttcaggtgccatcatgcttcaaactggaaggatcaagcacaatatgttctattttggatatgtgtaccactcttgcagctttgttagctgacatttcttggatatagtggcacactacttacttcaacatccccttctccttaccttcataacagcaattttgaggctttattttgcttacagttgattgattctcatgtgtgctttgtgcttcatcgcagcagttctatgttggctctttgatgagctataccacattacttactttcaaaactgggacaagattatctacatcactcttgagcatcaactagctactgccatgatgttaccttaccatgttgccttgatagccctcgctttagcaattttggatggcattttatgcaattgttgcgggtcactcagctatgaaaaatatgaggaagatatgatttctaagtatgcaggacaagagatccatttgaatcttatacaagtgtattactctaggctgtaattattacttctcttgggttgttgtattctttgcatgttaaggttgggccaccttagcaccttattgttttgtatcaacaaagctcaatctatgtcttttatgggctttggtctttacatttgttttgtacctcaagttatgcatattgcagtctcaacagcttttgtctctggggatatgtcaaggtgcatcatttgcttcttattggtcctcaatttggaagattatgccaattattttgaactactaaatatttacatacttcactgctgtcattaataaatacaagcttatgaatcatcaaggatatgtcaaggtgcatcatttgcttcttattggtcctcaatttggaagattatgtcaattatttcgaactactaatatttacatacttcactgttgtcattaataaatacaagcttatgaatcatcaactacctctttggtgttgctggactattgttcatatctcattatactgatgatctattggtttataggacttgttgtccttccatttgttactttggttggaccttcctcttatttgtttttaagtgcaacagattttagttctcatgctatgtaaataccttgttgtgttatactttactcagttttgttaatgcacagccactggctcctcagtttaccaaaaaaaataagatttagaatcattaacttgttgaccagaataataacaagaagcttccataatcaatttacataaagcatcttgggtagtagcctgagcaagaagaatacagtcatctacaaagagggcatgaaagattataggccctgtgccctgggtctataagctctaagtagcccaatatatagagttctttgcagtgaagaagagagcatctttgagcatgtagttatgcatatagttatatcttaattttataaaagctagtgctacatgattatgcataccacctgttgtggccaatctcctcgttgcctgatcaccgggaacgagcgtctgcaaaagaagtccgcactgaccggagtggctccggcggggaccctccgacggtcaagtcagagaggagactaggacaacagtagaaaagaatcaaggagctcagcgagtgagagagagagagctagagaggaagagttcaggggttgtgaaaagaacctttaccagcactgttgctttctccgttttatagtagggcgcggcatggcgccgtcattaatggcgcagacaatgggagaattgtcaaatcatcgaagactgtcagagtcatcgtagggctgtcaaatcgccgtggggctatcaaatcactagggttgacccgtgtcttaggtgggataatgctccagggcggctatgccacacgccgctgtcaggacggacagtcttcagtagtcgtacggcgtttgaaggaatcgaccgactgtatgtcggtgcctggttgaggaatgtcagacgaaaactcagggatcctccgatggtcagtcgggcatgttgcgagagtcggatatcgggctccacagttcggccagtcgggagcggaaagggtctgcccgactgacgtatactcggtcggtcggcgtcggcagtcgtcggtcggcagagtcgggcgctggtcaggcaggaccgacggtgagtcggcatgagggggaccaatcggtatatcccaacagttgcccccccactcctgagtcggatggtgtgctggccagtgcctttgcgtgggtggcggcgtcggacgaaaggagtgggtatccaccgtattgtatcccgactctgacgatcgtaccgttggctggtccagtgtcagatgtcttatgagtgtcaggcgactcatcggtatcagatgccccatcggtgtcaggcgtcccgtcggtgtcaggcgtcccatcggtgtcatgcgtcctatcggtgtcaggcatcccaccgagaatagaaatcaccgtttctgccgtctcttcgggaatgcgaaccgccacgactcttccgccacgtggcggggggccgttgggccgaacccgttcaggcggatagagtcgatgtggcctgatctaaggcaggtgcgtcgaactgtagggccgaaggaaggcccagatattgccacgcgtcacgatctgggagatcctcgctggtcgtgccttcatctcgaccgtcggagggcactatatatacagggtcacttgcttccggatttccactttccaaacttactgtcgagactctggttgagcggtcccttgcctcaggtaaccgtccccattgtcctttgttctcttcctcgcttcctcgtagtcctcctctttcttcctcttttattctttgacctctgttccggcgtaatggctagaatatctcctcgaggaagtcggtcggggaacccgactgacgattctcgatcgaccctggaggtggagatctcttcactttcggggccgaacgttgatcggctccgggagcagtactgcatcccagagcaatttcagctgttcgcccctggagccaatggtcgggttaacagcccgtctgagggccaggttgccttctacgtcgaggacctccgggccggtcttcgcttcccgattccggagttcgtctgaaacgtgctggactactacgggctatgttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatacacacatagatacatatgtatatatgtatatatacatacatacatacacacacacacacatacatatgcacatacatatatatatgtatacatacatatacacatacatacatatgcacacacacacacacacacacatattttttttttcctttgtttgcaaattattgagaaaaagaaatgataaggtgaggggaattagaaattgggctaaagctcctccacggagatgggagatagagttctactttgaacctagggtactttaaatgtagattttgagatgtagtatgctagaatagagtgccatgctaaatgcttatctgaaaaaaaaaatttattagctgatgacaaccttatttgatcaaacatcttgttgagttctgtgaacagaaatcatttgcttagagaaaggggcatcattttctgctcaggtgtggcctatacataaggctagctaaggaacacatgattttgtatattctagtacaagaagactgagagcttcccagaaacataaaacaatagggaacctagaatttgagctcattcactttttgacatggttattttcttattaacctagccattttaaaacattttttttttagaattggaaaagaaaaactctcactttttctctggtgcaatattatagtgtacaaacatccattcttgactttctgccttatggtgagcctgatctattttgtgatgatgtggtactactcactttttaatacatctctattacattatgtgtatggatgagatgacggatggggataaggggtggtatgtggaatagaaattaattttcgcatatggttcaccatctcaatactggactctatattgatatcatcttattacaatgttggcacatggtatggtatgagatggcaaggtataccgagtgtcggtatagtacgagactgcgtattcatttagtaccaatatggtatcatatcaactggctcagcaaaccttatattcacatgtgctttttggatcagttctagctcccataagttttatcctcaaaactaggacttttggttaggataaaattctggccactccaaagtgttttttcaagttcgtagtgagattgtaggtcaaagaaaatgaacccgcttgttctagtcttaaaccttatcaggctaggcctaaggatgcttgggaagttatggacaatcttttaaactggcagatcttgcattgtaagtaacatcatttgggtacaattatatatatcatttgaacttagtttgcatccctctcttcagtcttcagggcatcatgttagttcgaaattgtaccttgtactatgccttaatgtcatttatttatcattttcagagaaacaaagctgcatgaacaagttgcggatctttctaatcttatttattcatattcgtaccttattactccactttttgtaagtatttgtttcacgaccaagaaagaaccatgaaattcaattttgttcaaaaatttactgcattgacatgtcctcttgataaactcttttagcttgaactttatttttctaactgacataatccttaaaaatcatggacaccaatgtaagaaaaaagataaagttgtactcaaagatttagaaaatctctttgatttgatatgagtagccacaatctctcaaaggccttctaggacaattacaacttggttgtgactagttttggtgccacagtgaacagaaagtagtaaatcagtgtggcttacaaggggcactaattttgatggcaaggttgtgatgaaattggtacgcagaagagaatcaaaaaggttcaaacaactgcaccatattgcttagggtgtgttcgatgttgtgttttctttataaaaagagccagaagctagattttctagcttccttgaaaagcgtgtttttttttttttttgactgttcttcttctagaagcacttttcatataatgttaccaagcacttttatttgggaagattttttttttggctttaaaagtcagaaaagcactttttaaaagcaataccaagcatgcccttaatgccatcagacaagaagagaacaaacaactagattttgtatgtaattcccagtttaaattcaacaatcctttttcttttgtgtgccccatagttggactgctagcggagccaccaaatggctactcagagtttctattaaagaaattactactacattaaaaatgtggaataacagtactattttttccttgccctccaacaaaattcatgcagctaaatagaacttaaaatatttttcaatcagcaatttgaatgagttcaaattcctattaagtccttttagattctgggaaatgattgcattggagaacataaaaattttacccctaatgtccacaaatagttacaaatgagattggtccttcatgttggtaacatttcattaatgctatggatgatggatgtgttggattggaatagtagagacattaactaacgggtggaaagggggccaaattgaaggtttctaagggagtcgacaagactatattgaagatacaagataatttgactgaaacaattcatcaatgcatgtgatgtttaaatggttcaaggaagaatgagaagattgacttatcagcgcatggccccatcagtttagactgttttctatagcggaacctgtttcgctggggaagaagcatggatgattttggcgataacgatggcaaggatgataagatgatggtagctagatttcattttcaaataaaatagctcattatgtcttgacacactcacatcgtcagctgttgtgggaaaatctgctactatactgtcttgtgattgtactttaatcataattgaatgcacatgtcgtgctagcaagtttcatgttctgttgccttttgtgtagagtatgcataattcaatgtcgttatatataatttatttagttttctttgagcatgttcggttttctttctatttgggaaattcaactactgatcccaccacatcttgtacttttactagctctactgttttcaacttaaatgcaagtagagaaatgtattcgttgattctattttcactttttagactcatgatagtaggctctataattctacatagcttattaaaggagtactttaattactggtgcttgaatgtatacaagatttttttaagttttgatgctttatttaattcttatccataagatttggttggtttattcaataattagaatgtatgggccccatttgcatttgtacatgcattatgtaattgctccatgcatgtatggatggatgtttgtgttgtattctgtcctaaagttctttctatagccttttttgttatatcgattcttctcctcctcatctctactttctttttttaattaaaacctcaaacttttctgatataattgttccactgaatgtaagcagacctatttagtttaactggtgtggtcaaaattttacatgttaatacagatgaatgattccccactggggaacacatgattgagtgttcatgttgcccttgtgttataacactgcaaaagtttttgtcgtcaagctcgtatggagaattagatgcattcagcaaacaaatataaactcaaatatgcacatgtgaatgacatagcttgatttatagcatcaaatattgtataaaattgaacattgattattatgatgttttattctcctcttgtacaagtgctggatatgttgcgataaacactgtgcgtgttatcatcgttattgcactatctggcactttcatatttcatcacttcagttactgttcatacatctcttgcacaaatgccttgcacctgaaagaaaaaagatagttaatcttaccaatattatctgcagttcccttagtatgtatttacggctgatggtcacaatcattagcattgagtatgttatctgtaggtgagatagtatcagtatcagtttcagtttcatggttttgttgttttggtcaaataaattaagaacatcctaaaaataaaaaatagaagagaaacaaaggaaaccaggaaaagttactacagttcagaataatattgtcttgtatagtttctttatacgtgtaattttgtcaatttgatcttggaattaatatttcatgtgagtgaaattcatgagacatgttagtattttgtatttatagacatataatttacttcttcaactttaattgttcaaaaattcaccatattggcaattgtgaagcttttttctacctagtgcaaatattttcttgattttctaatataattcacaaatatattgaattcaggcacttcgtcataatatccttattttgaagttaagtggctatataatcaagtgcatgtagttataaaaatttataattattttacataaagcaggatgtcattttgtgaaatggattgatttagtttttcacattagtctttatagagtactataataagggcttctccaaagatctttgcctatcaagatttatttctattagcagaaaaagaaaaaaaatcatcaaaaaatgatattatatagcctatgtactgaagtaaataaagtaacaacctcaatatgacatagatactggaataaagcttaaaaaaagcatatatatttatttttgggtaatttatggcccaaactggctgaaatcaccaaaactaaatggaaactagttagtttggctgtaattgactgaaacttgaatccagggtcagttttggttcagtctttacccttgaccaaaaccaatcagcttcagctgaacattaaaaccccagatgatattgcttagtgagacaaggatgtgattgaaatgctaaactagaattaaaattgaagctttagaaggcgaaggtttgaaaagtaatataataattgaaagtatattgaaaattttcaatgaaaataaatatggaaagcatagccataatcaccatagatggttgggagatattattctagaaacagtttctatcctgtatcagatctgctttgaagagaaatagaaggatcaatgaagtcagttataacagaattcatgttggatgataagcggagaattcctgcattaggcatgcctctcaggcttaaggaaatagtttaatactacaatgaggttcgcaatgttgtattgtcaaaatgttggttgataaaaagagtttgagcacacaagataagcatgacaaagatgggaatattgacatgagtatgcaattaaatgaaaaactatatgcagaaaatgaatacattaaggctatctttgttttcatgaaataagtcccgaataagggctgaattaggggcttattcatccaaacactgaacatttattcacctctaaccagcataaccttattttagtcaactggtacataaccatgttaacctgcagaaatatatttggttgggggtgttgaataactttactctgcttttgaaatagctttaattcatctcgaattctgaaaggtcagcagttattaatttatttcatgttatccaaccaaacaacatttgtggcagtttgcttagagtccaaatagaattacaaaaaatttactcgtataaattccgatgaagttgaatatggaggaatacaaagaaataaaacaacttattcagattttccttattcgtgagccaatcacagcctaaggctgcatttgatagcaagatagaaatccaaggaaaagtgtctctaacctttgtcatccttccaagattcctttatccctggattaaggaaaagttgcttttcagttgggaattgttatgggtaactgaaaatgttggaaaaagtggagaaaaaagtaagagagagaagaagtggaaacaaaacaggtcctataggtggtgtaagagctgcacatcaaggactaactggtgggaaactgttcgagatggtatacgcatgtcatgtaaaaatggtgatacatttcatttaaaagatgttttacagcgtggtgctacaattttgattcatatgttttatatgtgatcttttgaaactgataagcttggaaaattatgttctggtttttataccttttcattccatggatgtatattaaaaatttgatatttaccttttttttttttttaaactagctgaagattaatttgatgtgatggattctgaaagcaagaagtttggaagaggtaaccatttcaggaaaaaaaaattgttgttttataatacatagacgtaacatggctatttttgttaacctcttctttttgtacttatataaattagcttgatgctcaagactaaatcctaatttactaccagtctgctagaaatattttgtgaaaataacccggcatagcttaacttgggggcgcagaattgaaacctacacagtaaaggttgctatcgttattagttagtcagccataacatacttggacatattagtgctatttcaccatgttatatgtttcgacagccctcggatccccatttgctgtttgctatcaaacttcagggttagatgaagattttgtgatggctgactcatgccttgactttaagatgctagtaattaggcagccagagaagaaaagattatgttgaacttgctcaaaatatgagatgaaaagaagggagaaaacctgtccggtatttcatttgttagtggtttattcttgatagaaacatcgggatcctcaatattggatgcgttatgttatgaatgttccggttggatttttagcctccaaattgagtttgtgctgtgcaagttctaaaggacttctctttcaggacctcgggaacttactggtgctgttgatctgatcaatcattacaagttgtgggcacaccatgattttttttgcaaaaggactctgcctctgtcaatttcagacacacactatcttcacaatgtggtgggtgacacagaaatccgaaagggagaagggatggagcttgaccagctgtttcagagtgctccatacttgagagagacaactgctaacatacggccctttgacttggacatccttgggcaagcatttcagctgcgagaaacagctccaattgatttaccctctgtaagaagcatttcattgcaatgggtttttgtagtttttccttttactagattttatgaaaggtcttatgtgacatcatacaggcagaaaaaggaatacctacaatttattcaaaatcaaaaagcgagtccaaggacaaggacaggaagcataaaaagcacaaggacaaagataaggacaaagacaaggagcataagaagcacaaacaccgtcacaaagatcgaagtaaagataaagagaaaaagaaggataaaactggacatcatgattctggtggtgatcactcaaagaaacatcatgagaaggtcatcgttttgcctggaatttctttattccaacatggctgacttttattcatcatgttttctaatttctttctttctttgtgctttttttttcctggatttcagaagaggaagcatgatggtaatgaagatctttcagatgttcacaagcacaagaaaagtaaggtagctgcggttaaagtttatttggcatttttcagttccgatgaattgcaattggcaatatatgtttttccccaacaataaagcaattctgattgttatatctttcagcataagagttcaaaggttgatgaagtgggaggataaaggatgcaggcgtaaaatctgcttgttcacatattacaaacatgccattattgattatttttttgaaggattttcttgcacgagcaccaaaattttgtgaggtatttatgccctctttttccttgccattatcagctatcttactttttatgttttttttcaacattgagtgaaattgcatatatgcagtcttataatcatatctaatgttggatatactgcccactttcttgttgttctaatatgatgcgatgcacaaactttctgaaatgatggtgtactgtttcaacaaacctggtaaaaattataagcagccaagtaaccaaccttagcagttatatgggccttgtggacggaaacaggagggcctggttggttgggcgagggagggggcaccttacctttggactaatatttagtgaaagaagtccctcccttgtcatatgagttttgtcttccgctccactctttttatgtgaactttgagcaaactataacattaaatgaatattctcataaatcactttccatataaattatctgattaccatagtaaattagtatctatatgtaatgtcattttattggatcaaaaaaagagtaaagtttttttagtacactaatgaacgtaaaaaaaaaggggtagaagtaaatgaagagcaaaagaagtaaacagacctttttccccttctttcatattaaaaagtaagtttttttatatgtttgttttctatcagagactcattatagcttttctttaaaatttcaaattgatttttcatccaagtgccttattgttatataagtaaatttatattcttttcaaatttttctaaatcgctatatatacattgtctggccattagatctttaattttaaatccatcaaataaaaaaagataaaaggtaaaatagtccattcacttgatctttctattagttgtgcgatattgatattctggaatttttaatatatgttatgcagaaaaaatagactaaagagaaatctatctaacaaaaagaaatgcaattcataatctgtaaatcatgaacccttatttgtttatattaataagtaagtctaatttttactcgatcatttgagggatggattgattggacaatgtacaacgatgtaagcctagcaattacttataatttgtttaggaaagaatttagataaaattttaatgaaaataagtacttttagtataatttcatcaaaataaatacaatatttaagtaaatagatgttgtctttggaagtatgtattattggccaccccaaggggagatttctggttccatgctgatgggcctgtaactgtatatcatgtgttaacacagccagctgcatatgtaggtttctttttgatacaagtgtgtgatcacaccactctggtgtgagtacgtaggttcttcttcattcctttgttgcattagataaaaagcaatgtgtatagaatcccctagcaattgtgagtgtacacaactaatgttaaagaccatctccaaaatgctaccagttgtcgaactttaaaacctggagacatggatgttcttatctgaaataaattaaccgttggttggatttacgctaccattgcttatgaaaattctcatctcccttttcttgtcctttgttgactccatcatatgctggctatgtaatccacctcagcatattgcatatgcagtcttttggttgtaaataatgaccgagataccattttggtttctcaatgcaatgattggatccaaaaatgaagcttacaagtgaggaagtatctgttgtataatcacagataaaatttataagcagcaaatgctactagcctgccactgtggatcatgggatcaacattgccaatttcatatgctgatgatgggcatgatgtttggtggaattttgaataagatttgttggataaatacccttttatttcctattatttagatttaagctctttgccaagtcccggtgttgttgcttcattttgtttctttgtgtctgaggattagatattaaacaaatatctctttgcatgattagctagcaatctttagcatacacaagttatcaagctttaactattagtgtcctatttgaagtaatttatgatatccaattgttggttgggtggttaagaatggctttgtattatttatgtatggctcgtgaaatttgtgcatcctctgctagctttaagatgcgcctttattatcttcttctgcacctcatctctgaattcgtgattttctctggaagacagctcttcgctttcattctgctcgcagaccctttgtttttaaaaggggaatactctgtagttgcactgcaacaatgcattctcatctgacatcgatccatgttttttgagtaatgcaggcttaggaagattgggacacctttttaatcaaggtgggagtggaaacgctcgtagccaagcacttgcactgataatatcagacctgcctaacagtggtctctagccactcctctctgttaacaaaacggactgttaactaactgcagtgcagtgctgtgcagctctttctgtctcctaatcactaacatatggtgccggggcagttagagcctacttgtaaggaacattaactcgtctgatccattagtcagcactttgaaatttaattattgagttgagttccgctggtatatgctccttaataaaatatggtcatgaaagcaggtttaccagttcagcggcttttaaacagtttgcagttgtggttcttgttttttaaatgccgcgcacatgatggaagaagctctttagcacattgtattgggcatcatagcttgtgtattttagaagcgcaaactgtggatgccagagagaaatattagttaaggccaaacattgctgcccccgttaatctatcggtggatctcaagtgatttgccttaagataatttttcatcaggttaatatgaatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatattaattcatatacaattacatcaaatagcacaaccatcaatagactgataattgatattgggatatatttttctataattttcatttgtactaaagtcaatcggtatagtattgtatacccatcttcattttgtgatcttcgaactcctttaccagaagagctttagtaaatggatcagctaagttctcctttatgtcgatcttttgaagatcgacgtcatctcgatccataatttttcagaccagatggtagcgatgcaaaatatacttcatccgctgatgtgtcttcgactcctttgcctgagctatggctccagtactaacgtaataaagcagaactgaaccatcgatggagggtgtcactccaagctcggtgatgaactttcttaaccacacagcttcttttgcagcattggatgccgcgatgtattccgcctcacatactgaatcaactacggtatgctgcttgaaacattttcagtagacaaccccaccatgtagggtaaagatgtattccgacatatttttgctatcatcacgatctgactgaaaattgaaatcagtgtatcccacgagtttcaagttagatttttcataaacgagccactagtccttagtatttctcaaatacttaaggatgattttcgcaaccttccaatagttctcacccagatctgattggtatctgttcactactcctagtgagtatgccacatccgatctcgtacatgtcatgacttatattatagaacccactgtcgagatatatgagattctactcatatgttctctctcttgaggaattgtcggacaatccttcttcgagagagaaattttatgacctatcgaaaaatagcctttcttgaaatttttcatgctgaaccgtttcagcatggtatctatgtacgttgattgagaaagttcgagcagcctcttagatctatccctatagatcttcatccctatgatataggctgcttctcccagatccttcatggagaactgtaacgataaccatacttttattctctataatgcagggacatcatttttgattaagagaatatcatccacatacaaaataaaaaatataattattgaaccattagcccacttatatatacagagttcctctccgttctcaataaagccatacattctgatcatcttatcaaaacatatatttcaactttgagatgcttgctttaatccataaatggatctctgaagcttgcacacgttagactcgtctgtggatgtgaacccttcaggttgtatcatatacacctcttcgtttagctctccatttagaaaagctatcttcacatccatttgccaaacttcatagtccagatatgtcgctatcgcaagcataatccgaatggacttgagcattgccacaaaagagaacgtatcatcatagtcaacatcataacgctgataatatttttgacaaccaaacgagctttataggtctctacctttccatctgcgtctttttttcttttgatgacccacttacaccctatgggttttatcccttcaggtggatcaaccaatgtccacacattattgatcttcatggatttcatttcgaatttcatggcttctgatcatttctcagagtcggacatctacatcgcatccatataggtgattggatcctcgttttctcatcgagctcaataggatctccatctcggatcaaaaaatctaagtatctgtctggctgacgtggtactctactggatcatcttaaagatgtttgtatattgggcttcgaatttgatcttatcaaatccggttcagattcagtcactggtatcagttcttctacctgtcaaacttcatcaagctcgactttagaggtatttattccttcactaaggaactcctttttcaaaaagtatgccttactactaacaaatatcttttgttcagcagggaggtaaaagtaatatctcctcatttttttgggataccttacaaaattatatttatcagacctagatccgagcttgggcctcacaaagaatgattggagaactcattggtcccaccctccttctagatcttgaaacttggtcctaaacgaaaaatagctcaagaagaaaggctagctgaaaggtcactaatcctaatttgtaatcgtttgacataagttggacaccctagaccttaagataagtgaggttcaaccttacgttttgatcatatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgagactgtgggtaggagttcagtatttaaaaataattttaaattttataaaatatttttattattaattttcatgcataattacttagatctgaaacttgaatcggctcacccttggattgagccgactcatcacaatgggtcgactaagttttgatacttagttgactcattgatgataaattattaatcataatttttggtctgttttattgagtcaactcaacagaaattgagctgactaaccaagatcctgagtcgacccaaacaatactgagtcaactcaacagacagattacaataattatattaattttagatcaaaataattttatataaatagtaataaaatcaatcataaattattttagaactattctaaacatatttatgattctaaattttatttgcaaaaattagatgtaaatacttttcatacaatgtatcatatacacaatcttaaaattttacagaaaagtaaaattttttttcgtattcatcttcatgggatatagtcataataacactcctacacatcgtaagaggatctaattgaatagaaaaaagaaatatctaatctttattacctcctatgactgaacggcctagtgacaaatccaatccgattacttcgctactcagatcatctaatctaaataacttagatctaatctaaattatttcagatctgattattatattttgatcatatcaaaattagataataatcatcataaataaattttatatacttcaatttaaaatcagattttataaagatcagcacaaactaagacaatctttacagtataaggggtaaaccttacagcaggataaccttatatcagtttgtgcgatcagatctataactaattttaaatttaaatatcatatatcagatctaatttaaattaaattatagatttaaatatatataatatcatatcatatcgaatcatggctctgataccactgttgtgatgcataggggtttcatgcatgcatttcaaaaaaaattttgcagtgaaaaatattagattaaactatttaatctataaatatattcataagatctgattttaaaactcctataaatagatctatgatatgaatttatatgcataaaaatttgaatttaaaataacaagtatgtgaatcaaaaatcagtatttagtaataaatctaatctactactatcaaggtttcagacccaatacttgagcatggatagccaaactctatgattgagaatgtgaatctaaaagttttctctaatcgctcacagtcgcacaagcatccaatctctacggatggtctacaaaaagccctcagaccaatcagccctccgtgggagtgctagctcgcgcagtcgatttctgatggtagatctgattggatctccttcttcgatcaccttggatcttttcgatgtcaaagatgaagtagaagagaatgctggatagtggaggaaaaatagatgaagacactcttctctttgattttttttcatccagaaatcttagaacagttctaggtctctcatacgagaaaagatcggtctcatcctttattcatgccaaagaagatagaagcccatccaaacctcatgccccaaaaaaggtatttggcccctctttctctctgatatcttatggtaaaaatcaaagagtggttggtgcataaaaatatgagctttttatggttgtcgcacaaatcaggttagataggataagaactagagtttgttgcaattcaaatcattttgaatttcaatttaactctaacttttttttacccttatctaacttaaacagagacctaccagagaattttaggcatgaaaaacaatcaggaacacttccttttgatcgcacataataggcgccttcataaggagttaacatgtggaaggatagggatagggttttaggtttaaatttaaatctttttaaattcaatttaaaacccaccaaatcttatccctaatgtgcgataaaacaagagttttagcatagatttttcagtgcacaaaccaatttgtgtgatgaaagaaggtgcaagggagagaagggaaggtgcaagggagagagttctattcattttggactctaagatttaaccaattgtgtttctatcaaacccaatccaattaaatttaataaaatatgatgaatctaatctaattagattttcataatctcaattaaacttgatcaaatcagtgaactaattgagccatagatccgatcaaatcaggatcatttctctcttatcgattaggtcatctcacaacctaatcaggcctgatctgattgaatccaattcaatcagacttgatgcagactttaatactcaatcaaattaagctaattagtattctaatcactaattaatcctttattaataataaaatcccagtctagtgggctcttcaccagagtctccgtccagtgggactcttcagcagagtctccatccagtggaactcttcagattagccatttgatcggagagaaacttctaatatgtgtgatcccataggttcaaacttaaatcggtagtataagaatagatttttgtatcaatcaaaataaccatctagtaatagtacctaatgtctggatagattaaatgtatgcaaagtaacactcaagaacctacttggatatagttaccgtataattcatccctttgacccttgatgctaggatgacttagagtttaaactgttaattattaacaatacatccattatgtgtctcaacctaataaatcatgtgactcctcacaaggactgtcctggtcaaggtcttactaaatttaaatagaaagtattctttccaatcttttggtgtggtcaattttatcttgactcattcactgacttcaccagtacttaacactatccaaacatctttcaatcctgaattagaaattcaagtagtccgacatcaaagtacaatgagttgcttgcaagtcatcatgaagatctcagatcggagagacacttatacccatatcttatcggagtgactcttgacagcaaagtactccaaagttgatcatatttagtaaaatatacttttatatttcacctgcataccataccagcatctctatgctctttggttaagaagacaatcaatctttatggcacacaatgacttacacttgatatgtctatcgtcctagtaatagcatatcatttgatcgcgaacttatttaaggactaaatgataaatcctcctttatagatttaaaatagtcctaagaacttttatcgtaacataaaagtttgatatagaagatatacaagcttatgatgaaaaattatcaaataaatatttttattaataattaattcatatacaattacatcaaatagcacaactatcaacaaactgatgattgactttaggacatattttctaataggagacagttcgatctgagaagcttgagatacgattccatggaggctgaccagtgtgggaggatggggctataaatacacccctctcagtattgtgcagtaggatttggtggaagagacggttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaccctaaaagtaatatgaaagaaatttaactattgaacctttttaattatttaattgattatactactatatcacattttaaggacaggtagaaatagaaaaaactatataccgcacatatcgaaatagttacacgctaggttatattactaaactgatgcattttttcaacaattagactcccaaaaaatctgtatattaaaataaataaaaaaataataacagccatccaagcgcatcgcatgcttcaagatctagttttgaattcataaacaggcgagttcaacgcgtgtccaaaatactgagaaccaggaatttgaaaggaaaggtcggtgcccttcagcatggaacactcgtcaagggatgacaccatccgaattaaggcacggggtattcactgcttgctgttccatgcaccccttcgcccccagccaacgagtccaagaaaactgattcgctacttcctttgaccaccaagcttccggaaaggagcaaaagttcgtgaatgtggttacaatatgcgtttggccagccggacaatcacaaacagcgcctgcatggttatttcctgacttaaaaataagatgaaacaataatgcctgtactcttcgttcgacaagtagccacaatagcaccggtgttccattacttaccagagtgacaaaatctagacaagacattgaatttgtgatcagttctaaaattccatcagcttatgagttcaacatttttggtcctcgttcgttagcaaccggcaattgttgaattataaccatagataggcaagtacttggtggttatacattgaacatcttgctggatatctgcatccattgaattgcggtctcgtgataagattccttcactggcgcagtcaacaagtgtgacaatttttaaggtgcagtaacaacggtgtagagatttacactggtataaaacacacaaccattttaacatcagacaagcagtaaatctcaggcttgatggccatccaaagtttgaagcgattccttgagcagcctccgagcctcctctctcctcctgaataaaatagacgttcaagttgtgaaagcagttagcatcttgcgagaaacaatatggagcggttacagatgcagttagtattttcacagtttaaacataacagaaatgatagctaaaaaggatttacaaagtcaaacctcaaataacttaaagcattaccctgtaatttttgcttgcatgagaaatgatataaagcatcacaaatctgtaattcgataagcattgtgtccatctcacgaagtaacaggtataccaacacttctatcattgtggctgtggttatatccaagttccataaattcaaatatttgtcagaaacactcctgatgtatttatgttcttattagaaaaaaattcttaagctgatgagttgcctaatttttgggtgatgatatcctttctaaatcttgtgtttgtaaatggtgagacaattattcctcataaaggaacgaggatctcagttttatacttccatacaactaagaaaagctattttatttctactagttgctgcaatcaactggttgactggaagttgctggaaatgggaaaaaaatgctgtgattagagtgcaatctgaaagatgaaggagaacccaagaattttacatgaaacatggaaattctataatgactgtatgtctgtatcaaatcatccatgcgactatggatctgaacaagaaaatgtcgatatttgaacagtaaaaagatttgagtactaacctttttatatcctctattgcttgtttgcgtcgttgtatctgacattctagaatgtgaatgagtgttgctctggcctaaaggtggaaaaataaaattacagtgccaggaacaagaaaatccatttcagtacataatttttagaataaaagtgaacaattaaattgtgtacttgatgaggacgcaaagaattgaggagatggtgcaagttcttgaaaataagagatatgtcttccactctacgtgcatattgggaaggtctctccaccagaacatctgctagctccaagatatgcagttgaagctctctattgagcgattgtaattcctttttaaaatctgaatgaaaaacgaaaatcttagaaataaatccaaatccataaaccacaacaatgtaaaggcagtagatgagatggtagtctggatctgacaatataattataaattggataatgacgtgtgccatagcttacacaaaaaggacttacaaacaaaagaaagcactttgaggttatagtggcatcactctttagagaaccctatagaagacagaaatctgacaagggaaacaaaaacagatataacacaagaatgcagcttggtaacttgatctgctgcataagcataaccatcaaatcatgttccaactattctggctttgttcgcctttgtttggttgttctccgattacttgcattaaggagattttaagagtctcaaagattaaaaaaagggagcgaaaaaaaatgaaaccaaactaaaatcacattcacattgtatgttcaatcatcagattttgttgccactctttattcttcccatccaataatataggaaaggaataaattacagcaacaccccttcaaccttccacgattttgcacttacaccccaaaaattctaattttttcaattagacactaaaattcaggtttttgttgtaatatggcccagccatctagtagaggtctaacatcgttaacggtgactatcaaattactaatttaccctttcatttttaatcagaaaaaccattcgaaaattatagagacatcccttaaaaaaatcatgattttcatgtgcaccccaaaactttcaaaaggttacaccgggtcccttgactgatatatctacaactatttatggggtgaaacccatcatattaaccatcttatcctttccagcactccatttcagtgccaacaaaccttttgaccatattcaagagatttgcaagagatcttgcttggaaaaaatgcccttttttcctaaaggtaagggagggtgaaagagagcagccacccatcatttattagaaatcagaagaatcaggggatatgtacagcggtctcaaagatcaaataattacagacagcagagggaaaaattgggtaaaaataaagtagaaagagctgatataacaaggcacatttatagatgtttggcactatactaatatcgcagaggcatcttaagcagagggttctaaaaattggcttctccagagccttcaatcagtgatggagctatagttctgagattggaacaaggagagggctaaaacatcagggcagtcagagctttgcatcactggtctttgagtacccataagccaaaattaatctaaaatctataaggaatatatatttgtggatgactagtaattaaacttaaggaacaccacaaaataattaagccatgagtaattcaaatcatcaaactgcagaaccatcttctgctcatcaatcaactatcctttgaaaatttcatctaacaatactacagctataatgtgcaaagagatataaataaatcaaaacaaagaagggacaaatatgaattttgatgctgaggttgaataaccaccatttagagtttaaaaaaaagaaagaaatgagaagagatgagatgagaagacaacaacaattatcacagtacatacatgtttcatgtatccccaacacttctcctagcccatggaaatcccatccaaagaggaagcatctaaggagattgggagatttccctccttgttagactactgccatatctttgacaccaaaaagctttcacctttggtagcataccaagtttcttcccctccaaaacctcattacttgttgaattccaccaactctccttcccctgaccctcttatcaattccaatcctactagagccaatgcaaagagacacttggagatttgtttccctaagaacatactgataagagcacgtgaagcagcatctccttgcatccaaagtattgctgctactctcccattcgtctcttcttatactacctctaacattgccattaccatcaacattatcaccaccagcaccaccatctctattgcccaagttcttgaatttctcaaacctcactgcgaacactctcatctcagaagcaatctcctccacttccaccagcttaccactgctagatatttgacaccaaaaagctttcacctttggtagcataccaagcctcctcccctccaaaacctcattacttgttgaatttccaccaactctcctccccttgaccctcttatcatttccaatcctactaaagccaatgcaaagagacacttggagatttgtttccccaaggacatactgataagagcacataaactagcatccccttgcatccaaactactgctgctactcttcccttcctctcttcttatactacctctaacactgccattaccatcaaacattatcaccaccagcaacaccatctctattgcccaagttcttgaatttctcaaacctcactaggaacgctctcatctcagaagcaatctcctctacttccaccggcttctaacctccaggcacagttgcaaaaatgggaaggagttgacgcgagctttggtcagaagttttgggccaacttcatacttaaagccatggaaatcaccaggttcctctcttctccctccgctctctgctcctctcttctcccttcactttctcagcaatctcttcttccttcgctctctcctcctctgtctcttaagtgaactaaaattggattttttgaggcccaatttactaacaaaggaagaggaatggaaggggtcgcatgattgctacgtgatctcccatttccgccaaaacacatcacaatactataatgtagccaacaaatatctggtatttcctctcttaagtcatattacatgactgtcatgttttcctgaatcccgacgaagatggacagctgggccacattacaacaaaaacctaactcttgaggtctaattgaaaaaaattaaaacatttggggggtaagtgcaaatcgtgaaaacttgaagggatgtcattgtaatttactctacaggaaataaagttccacttttttcttctctttatcattactaatagcagtacaaaaaaagcaaccaatattctatattccaaacgtcatatgttccacacaaatcatgttaagaacgaaagaataatggctgccaatttcaaataatataggtaattggcatggttgccagttttcagatttcaatgttttaaaaactgaaactagtttctatttttcaaaaacctcaaatttgaaacttgtttggcggcaaatatagtgatattggtggaaacagtggtgatggtggttggcagtggcagtggccagcaagcagggagtggaggctggcaatggttgttggtgacaatggttgttggtgacaagtggtaggtggaaatagctggtggcaattggcggtggcagctagcagcaagtggtggctagtagtggtggcggtggccggtggttgtggtggccagtggtggtcggtgattaccggttttcaaaaaagtcaaaatcacattttctagtttacacaatttccagaaactagttgctagtttcaaagaacagaaaataaaaacagggttctgccttgatttctgtatttgttctaccttgatttgtatttcatgccaaacaaagccagagcttctccactaatcatcattgagccccacatctccccccaaaataaatttattaccaattaagatatgggcaaaaatggctgtctaaattatattctgaagttttggaagatttaagtttcacattgtgttcttccaaatatagtgcaacccatcactgggttgccacttttgttgcagagcactcataagggattctgtggaccgatgcggcagttgttccagtgtctttccataatattttattttctaactctcttagttgtattcatactagaggttaatgaatgctgtgtcttatttaaaaaaaagggggggcccatacagtgcgactcacctattggaaggacctaacagagttcagcccatttatctttcacctactcacaggtgacttggaaacttcatcaagagaaagtgccacctctttaatttcttccttatttgacttcattgtaaagaaacactacctcactgatgtaacccccattgatgcaagggattacttatccaggtctgaattttgatctgaatactgtgcagctctggacccttctttctgttgcacaaacttaacagcatcagacctgattatcagcaagaaaactgctttttaacagcagtttttagcacaggaatgagataaattaggtttgaaaagagcagaagagggagtaaatcatagtagaaaagataaacaagaaaaaaggatcactgaaaaggggtcctgcagccttttgattactagctctcacagaaatttttcaatcaccagtccatcttacaactgtaaacatatacctttataaagcatcagcatatcacctttcctgacacctccaatgactcttttagaaggaaataaactaaaattctaaacaaccaactcaatcagtggaccgcattcaactcctactaggactcctaatttaagaaacaaaccagagattaaatactagattgagatgactagctgacattttcccaagaactaataggaatcttaacagggacactaaatactaaacctgatttctgactgaaatactccacaatgatattaatcagacaccttttcttgacttaaacacatgctaaagaaatatatgaaaattgtaagaacatagagatataagtctcaaagactgaagaaatttaacaatctgattcttcaaattcccattcacattaatacggcatcctccttttatatccaaattttttaacctttgcattggcttcaaaggtcgtatcatttccatacaatatggagagcctatgagaaagaaagcactgagcacttcaattcaacgtttgccgaaccatctcgaaccggatagttcaggacatttcgagccgtatcaatgacaaaccgtgacggtttgaccaggcaaatcagaacattggaggaaggagagaagaagagaagaagagagagagaggaggggaggaaaagagcggatgacgccatcggaggctggcgatggcccatcgaggctgccgaagggccaaggaggcctccgcagctcggcgtcatctaattctatagctcagcatcgtccgataaggtatttaattgagagagaaagagagagagggagggagaagcgctagtatcgatggagaaataactacggagaggccgtcagagagcgtcaagtgaccatcgtggccatcggacagtgaaaaatatgcaggcggagatgctgccgccgcggaacaggggcgaccgtccctgtttagttcatcgtatttttttaaaaatgacgataaatgataaagccagcaataggtttgtcgccttcactgtgatcgtgatttttttaaaaaaatcatatgaaacaggggcaatcgcccctgtttcacgtccgtagcgccacaagccgtgattgcaccgtctgacggcctctccgacagcttctcccttcttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatattaaaaatatttcaagaatcttatatggtatttatattcaagattagacataaagaacataattcagtatgctagcccaaaaaatatactaatttatgtcaaaataaataaaaatataatataacaaactccataacgatacaccctcctctttttttgggggatgagcgcggagggagctaccatataagaagaggatagcattgaaggcctcatggatgggattgaaagaggaggacgagaaggaaaagggggtaaaaggagagagaaaaaggggtctccgggaaaaaaagcaaaaggtggagggagccgctgtagaggggaagcgctcatacgtaaggatggcaatcgaatcagatcgatcatatatgggtcggatcagatgcaagtcggatcaaaaaattctaaatttaaactcaatctgtttattaaacaagttagaatttacaatataaacctatcatatttaataaacagataatctaactcgatctgtttaacatatttattaaatgaataatctattaacccaatctaatccaacatatttaatctgtttaataaatgaataatttgttggtccaatccaacttgattggtttaaaaatagaacttgttagcccaacatatttaatacatcaagtagcaaaaaaaatatgaatctaaaaatagaaaacattgcaataaatttttctaaatagcattttcatttaatcttttttttggaagctataatttacattcaatatttacaagaagataaatattgaaaaaatttcaagaatcttatatagcatttatattcaatattagacatatggaacaaaattcagcatgctagcccaaaaagcatactaatttatgtcaaaataaattaaaatataatacaacaaactccataataacatgccaacatatttggcaacatacaaaatttgaaaagtcaaaccacagccatgtgagcatttcttgatcctaaaacaaagtgttattaaagagtccgtatcccaccagcttattttatgtagatggctgaaataaaacaatattctataaattatcaattgtgcttatcccataaaacaacattccacaagattagagttattgttcattgtgtagttgaatacttaatggaagttttaccatgacttaccataataaaaaattatcaagttaaaaatagttaaagaaaaaatatatttcattacttgcaatagtctagcttacctgtaagcagccatacatctggattgttatatgtggtgaaaagaacaaacatttgatataatgtagaaccatagaaataaaacatggtccttccttgtcttcaaatgtcacatatgctaaccaattagagaataaaaagaatagtagccaaagagcctgaacttataaaaataagccaagcacctagaaaataagaaaaacttgtgataatttctagatcatactaaacgagaatatgatagaattcatggcaagcaagtaaagaataattgtatacattttgagagataaaacaaggaaatatgaaactaaaaacttaccaatacataattataattgtgttctgatctgtcaattacatatatagctaaatcaaaatagctacgatcggttgcctgcagaagcaggccatcaaaggttgcttactattagaaatagttgattcttcatgaatcagcaaaaatttattgaagaatcatcttagcctattcatataaacaagtaagaaaataaattaaacatataaatcatgaatagaaaacaaacaatcaaaattttagaataattttacagcaataatttatacaaatatcaaaattttacaaaaacataatttaagtataatagatttcattgaaaacacttacataaacatatctatttctgaatttgagtaaagattaagaaaagttcatcactttcatcaagtaaatgaaaggagaagtacaaaagatggagggagagagaagacataagaaaaggtattttataacagcaaagttagcaattgtactaaaaaaaaataaggaatccctactttataacatagtaataaactaagtaaattttaaaaatatcaaattaaactatttaagtaaacacctccagcatatgcatcagcatatctaagtgtgcattagaataattatagccccaatccccataaagcagtccatattttgtaccaattactcaacaaatttcaaatcctctcttattaaggcatgagaaagaacattgatctaatccattctcgattgcaaagaggaaattttaaaaatagatgcaacttagttaactaagttcctatttggtattaattaatggtctgtctatcgggtatcttatttctatttgatgcattaagtcacacgcacatatgggccaccacgattaaatcaatcgtaccaaaagaaatcatatacacttagtaggaaaatatttggagttgcaaaacttctaaaaataccaaacttacctacaacatctcctagatgcccaacatttaccttggagtgatgaggtttcacatccttgtgtgatataacaattaaaccaaaactctcttcgaatgtaagagactgaaagtaatacaataaccttctatagtaaagctagtcatctgatgtttcatagaacttaatataactctagactttctaattgtatcaaggatcgagtcacaatgaaactactgaaaaactatagatgcaaacaacacatacttctgaaccatttttttcatgcagatttctttaatattaaaccacatttacaaattaacaaataaattgaaaaaaaattcaaaagctggacacacagatttcatcaattatctcagttgcaaaacagaacccacaaataagtaaataagaaatccaaaacatcacaaatgcagtgaacagatatttcaattatcactcaatacagagtgcaatggaatgcagcatggtacatgcaattgcaaaaatgattaaaaaaaaagaatattttaggaacaaaattaaaacaaaaaaagaagaaaaaaagatcattgccttactgtctttggatattccctcacgttgatgacactgcaatagaacattaagccaaccataagtccaataagagacgaaaataaaaagcaaattgagatttaagttgaggaagaagatggagatttaagagacttatggtttgagatagaggattagatctagatcaaatcatcctcaagcaagaacaccagagaaagagatcactcattggccaaataggggcaagaaagtttaaatcctaatacctgactaagatcatcagagaaagaggtcactcattagtcaaatcaggactttagagacatcaagaattaaggaagaggttgccacttggtcgctacttactcgatcgatgagaaatggagcactctctaattggccaagagcaagagaaagaaaatcagagaactgaaagtctaagagatggctgatgaagtcttggggagtcggaagagatgagtcgaaatagtgggccacgtagtagagatttaagagttttcattccaaatctatagtcgtgattcataaatagaaattagaagcactagttttgaattttaaacaggccacccccagatccatttgcctagggaaccaagttaaatgggttatccaacccgacccaaaaattaaataaattaaacgaagtaaacaagttagacatctgaaatctgaacctaatccaaatattaaacaggctaaatggattaatctatttatgatccgaatctatttactccaaattcaaagctatttatggtgggtcgaatatgggttgggttagcggattgggtcatatttgccactcttactcatgggtgagcttgaagaaggaggacaatgatgagaagtaagaaggaaggagaggagggagaagaaaaaattgtcagcaaggaaagggcgaaagtacagagagccaccataaagagggagggctcatgggtgggcctaaaaaaggaggaagacgaggagaagggggtgaggaggaagaggagggagaaagaggggtcatcgatgagaaaagagtggagatagagggggccacgatggagggagagagctcatgagtaggctagggggagaaggatgacaaggagaagaaggggatgaagatgaaagagaggaaagaggggttgtcagtgagaagggacagacataaaaggagtcactgtgaagagaaaaggctgatggatgggcttggaggagaagatgatgagaagaagtagatgagaaggaaggagaggatggaaaaggagaggttatcgacgaggaatgggcagagatggagggagccaccatagaggtagaggtctctttgatgagtttggaggaaaaggaggaggataacaaagaggagaaggggataatgaggaaggagaggaggatgaaggagggatgttagtgatggagaaagaggagaaagggagcaatcgaagatgagagagaatgaaggaggtggataagggtagtttggttattttataaaatgatagtactatatgatggccacgtggcatcatttcattaatggagataaacggtaggacaattttagaatattatgaaaacttaaagagccagtttaatattttttaaagccgagcagtgtaaataaaattagactaaaattgagggaatatacttataatttactctaaaaataatatgaactatagcttattgattaagattttggttaggcctccaaagatttagagttcaaatcatcacgtccttgcatatatttttataaaaatttataaaatatatatgggggtgcaaatggatcaagttgatctgtgacctgatccaatctacttagatccaatccaaatctttttaacggaccaatagggtcaaattggattctgaaattggatccattctattttttaggtatggtctagatttactgaattccaatgatccgacttgaacctaatatacgaatccaagcaatcaaatgcataccctaggtatactttttaaaagataccatgttggttcattaagagaaaatgattctagatataattcagatgaattgctagttcctatgtattctttaataatctagtttgggttgcaagcctattcttattttgtttttctttcaaaatttatagtggtatatggagatagtgagagatgttgatgatttgataatcataacaataaaaaatacataattaggtaatgtctgttttagctcttgacacaaagtcggagcatcatggtctgcacaaattcaaactaaaaacactgcattgaagagaagaactcaaaaactttctcatatcttttacttcttcttactagaatttattagtgtaagtgcaacatagctaggatccaatccaaacctgaatcaaactcgatctggacatgaattatttggattggggccggattatgcatggacttgactcaacccaaataacctattgcgtcaaaaattttgatcttagattcgatccaactcgatcttctattaaattaggcctgggtccaatattaaaatccaatcaatgaaccagatcgagccaaagtcactcgtgacaatccaatctaatccttttagatcacggacacctaaggagcaaatcccaaatctgaatgaattttaattttaaatctcaaatctcataggatattactaaatggatcccatgaggatttgggatggatcgggtactcgaaaaaactcgctgccatccatattttagacttagggttggaaatgagatgggccacacccttaacccaaaagtggtccaaaacctttctcaagcttaggctggatttaggaccaaaaattgattaaaaaaaaaacaccagtctatgtctgacctatagagaaagaatagaggagaagagatgacaatgttatccctacatcccccaataaatcactcctttccactcctaattcttcccaacttctcatgcgctcaccaacgatcccaagctcaagcactcctcctccacaaccgctgccctggtcaaatcttcggcatttatcactgtcgaccctatcttagagaaccgactagcctaagttcgacttaagtaccgaagcagcattagaaagaaggtgaagcagcgataagccaaaaaattggatggtggcaagaagaaggtgatgttgctgccgatgctgctcaaggagaagatgacaatgatagggctggcggtgaagataaaagaaaaggagagagagatcatagtatttcaaaagaaccatgcttggccaacgataggagaccgacgactagtgaccggtgatgagggagatgagcttcagggagtcgataaatcgataaccctagttgatgaccgatgattttgattagggatcaggatccaaaactacttgggcatggccatagcccgactcaaatttggcttggacccacttccagtgaggatccactggatggcctggatggttgtggatctgcttattgctattatccggccccaaaaagttctatcgatatttaatagtaaggctgaaatttattcgacttggtgctatccgtcttaagatcaccatgtttttgaacaaagcattgttaaataaataaaagagcagagtaaaaaaaaatctcgcatttaacctagactaaaatccaccgatgatactacaggcactggaataagatggttacatttttcatactctcccaacaacgcctactgtgtatcaataggggctggaatgctgttagtggttctacccgatgcccatcaagactcaagagggcacagtttgttcccatgtatttatctctttctgggaaattttatggtcactgcactacaaggtaggatcatcatcactcctcggatattattgttgtagttattacagaacaatatcatgactatgatcatcaaagatatttgggatgatgtttgtaaattcttcttatatatagaacaaaataactagaatatctttatattgttgggaagggatcatgtccgtgagtccaaatctgcactcaaagccaatggcaataccttgccaatcagtttgagatgctaaaaacgacaaaaaaaaaaaaaaaaaaaagatcatctccttcatccaacaatctcatgctgatagaaatggcgtgagcatattcttgaagctagccttttgcaagagtaccgttgtgaaagcaatggacaaatatcccggtaattgatgaattaatggtgaccaggggctgcatgtgcaatgttggggggaaccagaccaaatcgttgcttggcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctctctctcttcctccctcccccttccttttccacatgggaatagcaccacgggttgcttagagaggttgagcggagaccatgtgcagtatacttgaggtctgacgaaaagcatgaacaagaaagcctatgatcatactctgcttcatcctcaagcctttcacgtacggtatattgtaaccttaacgttcacagttcgtgatgctgatgcaagtatacacctattacatctacggacgtcatcttaagagaagccgcccgccatgccggtgttcttagtactgttcctttgtctctagcgtatggaatggacctttgaattagacatgtgagtgcttgcgaacttccggtgcacctcctcgtaatgcgcgagtgcatgttctgacgagcttcttcgatgtagtgaagtgaaaaaaaaaatattggagaaagaatgatcgttaggttgactaggatttaaataagacggagctggattgctccttcagtcctctccatccggcaggtacgactttgctacctccatttgtggtggctaccggctctaggctctggtacggtacgatcgatccattgtcgatagcaatatttttatatcacagtttgaaaagaaaacgcgtttcctctgacatcgcaggtacgcatcataataaatttacggcaaatgctgctacttgggatatggaatccgatcaagttgcaggacaccccaagttgaactgttacataacttgcatttcatgccaattagcatgggatactaaattgaaggtcaaattttggaagtaacgggtttggatgcagtcaactaaaacaagcagcagacatatgatcgtgcttcttctttaatagaagaggaaatctggagtggttgaagcagtcgaagaactaaaatgtggtacattataaaaacagaggtaatggatcgaattcggcaaagcaatctagtagcctatcctctttccggttttgtgaagagcgatggaaaagactgctaattactttggagctaccctgctgatattgctggccttgctcgcctctgactccagaggatcgatggctcaatggatacctgcctctgccacattctatggaggaagtgacgcttctggcaccatgggtagggtgaccccccataatatttccttggcctttcatctatgtttatacccgacatttgtttcgggctgctttaatcatttgcatgcatgattctagtctagtcttgcgcatcaaatactaaactcacaaagcaaagcctgactttgataacaataaacccaatgcacaaaagaaattaggcaaattaagaactcggatctgtgagacttctcatcaatttccaacatgaacagaccattatcaaatccgatccccactttctgagattccaaaatacaatactgcatgcttcccgtctaaatccctttgggccaggtataaattttgagcaagcgtcgcatgaacgcagggggagcttgtgggtatggaaatctatacaacgatggatatggcatcaagagcacggcgctgagcacggcgctgttcaacagcggcagttcgtgcggtatgtgcttccagatagtttgcgatgcgagcagctcaccgtggtgcagaaagggcacgtccatcacggtcacagccaccaactactgcccgcccaattacaacctgcctaacgacaatggcgggtggtgcaacccaccgaggaagcacttcgacatgtctcagcccgcctgggagaccatcgccatctaccgaggagggatagtgcccgtttactacaggaggtaatgcaattctcgagtgcaactttttgcgaagcaaaacacacacacacacacgcacgcacgcacgcacacacacatatatatatataagctaatcgacattcccatacatctgcagggtttcatgcctaaggactggaggcatcaggttaaccatcaatggcagggactactttgaactggttctagtgtccaatgtagggggcagtggcgtcgtctccggcatgtggatcaaaggatccaacaccgactggatggtgatgagtaggaactggggcatgaactggcacagccttacctatttgaatggacagagcctgtccttccgggtgcagacagatgatggtcaggtcaagaccgcatataatgtggcaccttccacctggaagtttggcgacacctacgccacatcaatccaattttaacacttgatctggagtttcagcgcacagcagcaacagcatgccgctgcgatcttcttgtgtcatttttcaatcaacaaaaaaaaaaaatcttcttgtctcatttgtttcctcttccctctttaaggtatcatattatcccttacctaggctgtggcttagataaaagtagcccacctagcagcatgattctgtggaataaacgatcaaagctccccttggttccattcttctgttcgcaagctacttgtataccttcaatagaagctagagcagtcctgaagttgattccaggaccgaccatccttttcgttaaattgagggggggaaaaatacaagagccagtggagccaccatgtttgctgaataattacctgatctgatgtgcttaatattagtacactaaggataataaaccacgattggtggatacaatatttcgttgtgcttgtaaacttcaataggacctgaaattttaattccccactgaacattagtagaaaacgttacacactgattggcagtctcgatgacataactttgtcattaacaaccaacaatcctcatcaaatacagcttcatcaacaactaataaaattggaaaaaagatgattgagactatggcctttatttatatctctaccatagcctgcaccgtcacatggttgttgcgattatccaggaatcaaagaacagcagaatccagtaagttaagctgctcgtgaatttctggggcaaaaagtgaagatcaaaataaatgacgcagtacacctaaatttattccaattcatcatctaatctttcattggcaacataccaactcttggcaatagagcattgattaatatcaacttaataatgtcattaacaaattactatatgaatttatagatttacaaacactaaaatgagaaatatggcatccttattacagactactgcagaaacatctattcgagagtctatacatttattacacccaataagcaccccgctaaagcaaactagtgagaccaccatacttttagctgaaaactgacaactattatgatattgaaatggtatgtgtttacccaagtatctaaaggcacattacaaaaataagagtcagcaaaggcattatgaattcccataatgttcatgacatcatgaaatcacgtttattggtccggtatattggtctgtgctgatttggctcatgcaatggggcatcccataccatgaagttataaacctcatggtgcagccatgcttttcaatagttaatgaccaaaattttgagattataggcgaaaagggattccaaatgacagtacaaaagtcgattgacaagttcaaatatcaatcttcgaaaccaacttcatggaaaaaacatgtcacctagaagcagtcaaatacagaccatagcttacatttccttcagattactttcttccttcagcacattgcccgtgtggtaccattttgagcatcgcccaaagtagcaattccgcaatccttccgcttgcctatctacctcaagggatgcaacatcctcatcaatgacacgattaagttttcctgcctctaacctcccagcaaaaattattctctcaccatctttatcttgttcactcttcgacttcaacaaaaagcagcccatttcaatatgatcaccgtatatgctgaagttcacttcatcataaacttgatatactttgaattcagccatttccccatgaacaagtaagatctctcttgctgcttgtttctcagatgatacaaacatatgaactgccatagtacatactttaacgttagttatagtattactgaatctgatgcctagtcttatcagcatagttgtggatcctggactagatgctcatgcttctttgcagcagaataaaggtgatctcaagtaagattttgaagtacagaagatggtgcaagaaacaagtaatagaaatttaatttaagaaaaatatgcaagaaattcttgtggtcatttttaataggcaggtacaagaggatttccctcactggaacatcatatgcaggtataggaggaacattatatattcatacacatcaccaaacttcttttctacacagcaccaatatacaaagaattcacaatattgcccctccaagaatcattgagtttacattggcaagcaaaacaaatattcttggtaattgcttctttattaattgaaataaacttccttgacagagaaaaaaaaagaacgaaagcaattaatcaccgctcctcaaacttaatcaagagccaaccagctctctcctctagcaattagtgatcatttttcaaataataatggatatacaatgtctaaactatttgcttcatcattagtacctacatagtttgaggacaaccaatttcatgctccatacatgttagaaaaattttgtaatttcattgctagataacataagtgaaccttacatggcagcttggttgttttccaggtccatagatatctaatactgaatgctgaacaccatattatacgataagatggactgacttcttcttaagagcaaaagcatccacttggatcaaatttcgagccgttgaatcaagattttgccaaatagaatgatttagagacaatttttaaaaaggaaaaacccttcccctctgttgcaagccagagatgtgcaaccctatggtttgactaccctagagcttatgccaaatacaatgatttagaaagttaaatttttaaaaaggaaaaccattcccgtatgctgcaagccagagatgtgtaaccctatggttcgaccaccctagtcataattacttagggcactacaagttagatccattggaagtgctcatatggaagcccaagaactctccaggaaccatgtggatcaagctctgatccattggtaaacatccactgcacaaacattccgatgccaagccaactgcagtcaaaaggcaattgacggtgaacaactgaccatcagaagaagtgcccgacagtgccacattcaccattagaagatttccaacaatgcttcaatcaccatcaaaaccagaaaggtacatatcccacctctattctgatggtaatgtatcaccatcaaaagatttttgacaatcccatattcaccgtcagaaaccaccttctagaagatccaaccacacattaccaactacccgaaggactaggggtccagtccgagctgaagatcaagactaagaaaaccgatggtgaacctttcaccatcaaattagaattgacggtagcataactaccattcgaagcattccgacggtatctaggatgctggcaaaatacttttccttctacaaacaccctttcggctagaagtcttagtttaggtgttttacgagttttatttcaagtttttcaagaactggtataacacccagctgtccttatcccttgtaaccccttgttttcacaagttaatgagtttttttttcttttttttttctttttgtgtgtgttgagggggggggatgcaattttgctccttttttcttgtctaatggattctgtacaagtctcgatagaatttggaaatgacagcgaggccaataggtgcattccttggttgtggcatgcttcgaggcatcaattggtgaattccttggcatttagaagctctttggtcacaaagtgaagaaactactaggtaccttagctcttcgatctagtttgcctaggcctctagtttttaaaatgaatttcttactttgtaacttctagatttaagtcatatcttgcttaagacaattaaattcttgcttagatatttacaatcttccactactttaaagctaaagtcaagccttctccacccacatcaacaaataatagtattcaagccagctctttcctagtttccctagcacaatcctaaccaggagtctgatgctggtaactcaccacaccataattgccataataacaaccagaaccagcaacatggcaaggataaaataaaatagtacgcttgaccatagacgacttctttagaaagttggagcatgcagcattccaaaattagctagcttcaattaatgactatttcaattggcatcacttatccgatcggaagcaagtccaatttgttaaagctaagtgaaaaggcccagcctgcatctggcggtctaccttgcacagctgagtctattgtggtgcaagacccatcacaatgtgggctcagatgaaagctgtaagattgctacattctttgtgactactcccaaaccctttacacttggatgctccagctgaagcaaggttccagattagtgcaggaatactaagaggaatttgataagattattctacgcttcatttcagcaagatcacagtccaataggtggctaggtttcgactactctagtgatgattacctggggcctcatgaattagactcatcaaagggtcatatgtaggctcgagaactctcaaggaaccatgtggatcaagcatctggtagcaaaaatcccactgcctgaaatgttttgatggcaagctaactgctatcaggaggcaattgatagtgaacaaattcaccgtcagaagaagtgcttaacaacactgcattcactatcaaaagacttccaagagcatcacaatcgtggttatagtgagaagggtccacgtcccacctctattgcaatggcaatgtaattaccattcaaagacgcttgacagatccatgttcaccatcagaagcctccttgtagaagacttgtagatgaagcaactgacactgagcctgactccttcaaatcggatagcacagtgtcaaccatccaaaggactagataccaagtccgaatcgaaggcccaaatggagaaaactgatagatttcatgtcagaagaaaacctacgatagcataagcattgccttaagcattctggcaacagctaggtcgtcgttgcaacacattttcttgtagaagcaccctttcagtgagaagtcttagtttaggtgttttaggagattttttttaaattttaccaaggactctcataacatcagtcatccttatccctcacaggcatcctagagcctataaataccctctatgtacctcctgtattcccagctaatgagaattattttcttttgggtgctatctttctccctttttcttgtgtagtggattctgtgcaagtcccgacggattctgggaacgatggggattccttggtcatgacatacttcgacgaatcagttggtggattccttaacatgtagaagccctttggtcgcaaagcgaagaagctaataggcatccctaggttgtagatctagtttccctagccttccagttttcaaattaatttattgcttttgaacttctaggttttgatcatatcttccttaagatgattaatttcatagataattataatcttccgctccactatgaagctaatgttaggtctccttggcttgcaccaccctctctctcaccatccttcctctctccctctctacctcccacaccaacccccctcgtccattcactgcacaccaccatccactcctccttggtcccaccacatgttccaacttccaccccttctctgccttagctccaccatggccacttcacgtttgcttccccatccatactcataataacccatctccaccatcctccaccataagatcaataccactagccccttcctccaccaactacatcgaccatcttgctcttcctctatcataacccacctccaccacccttgtccttcatttgctccattcacccatcccattcctctgccacaagcccaccaccccaacatgctctcattcatcaacccttcacatgccatgaacattgtggaaatcatagtggaggaattgggtgaaggcgatggctaaacaagggggttagcaatcatagtggaggaattgggtgaaggttggtggctaaacaaggggattaggaagggacagaggggatagggcaggaagtgaaggtggaggatggggcataatggaagggaggataacaactagggatgacagtgatgtgataatgatggtaatgggaggagaggtggatgaatgtgagcagtgaaaggacaatacaggacatgacaaaacacgctgggatgttgatagttggggtttattcaaattcaagaaagatgattctcatttatctaaactgaacatatttgaccccaacaatctaaaatataacagaagctgtccccacaacaagaaaataatccatctcttatatggctaacttttgtcaataatctgatcttatgagtgtcaaaaaagtcttgctgaaaagtctatggctagacatatgaaagaaagaaaagagaatactagtgaaaaatgaaattaacaaggaaaaaaaacagatattacaaaattgcagttatttaatctaaaaaaccaccacttaaagcaacaaacaactagcacacaactgattatgcatcagtacatagccagcagcaaatgaaaaataagtctctttgacatgactattcatattgcccagagtttaccatacttagaagaagaaaaacaacaattagaacaaactaatcccataaaatgcaaatatcaattaaaaatgttcattaacttcacaagaaatttgcatttttgaattagtggaaatcaaattcttagaaccaaaacaatgatacagagacaatacttaaaataaaagccactcctggcctttcttgttgactgagataatgttgcggacttacatctactactatctgcgcatgacacgatttctttctctcttgcgaaaacgctcgagcatgaactcatctgtggcagcttgcctcctccctggaacatctggattattagtttcagtcgatttggttgccacttcactagtttgtgctcctcggtctttgtacaattctggatgctctgcatgtagaaaaactaataccgatgagtgccttaaatgcaaaacacgtgtggtatcaggcatgagtaaaacacaattacaattcaaaaaaggctgataattgatgtacccaattaaaaagtgtggggatggctaaaataacacataagaaaggccactcattcaattgttaaggattataagaggaacacatagcagtcaggccaaatatatgtagttagcaataaaggatttatatttacaaagagatggcaaagcggaaaccaggaaatgaagcaatactactacaagatcagaaaaattaacttagaaatgttgggaatatagaagatttggtaaaaaatgaatgctgcactgtgcagggatgattcagtctatgaactggcttttccatagtgttatatgtgctagtctaaatagcatctcatagtgcacctactgtaggagacaagaatcccagccaaaacattaagccaaaaggatgaaaagtttgcttaaagaatatcataaagattctttgagcttattaaatcaccgagacacctaatctcatattctataaatagcaaaagcatattttttttaattaacttcatggattgtcaatttccttttgcattaatattcaaattcactaggatgaaaactattgctgccactacttaagttggctgatttgtttatcaatacttctctttaattagcataaaccacatctgcaggacccccaacacccataatagatcaagttgatactgtcacaaattatgataacactccagttaaacaacaagcttcgaaagtctgtgtatagtaactatcttttcacctgctaactcttatctcaagagtaaaagagaggtttttaatttccactaaaatcaaaatgaaaggggtggcctagtgcatgaggtttctgctactatgaggtctgaggaggtcagatgtatgcagtcttgtccacgtatgtgaaaaagctattccatgtttcaatcctgtgaactagtgacattgaaatcagaatgaaagtcaaccatgattttggttttggtaattttattcaatttcagccaaaactaacaaattttggcccagttttagtcacttttgctactttcagtccaaattaagcttaagctttatactgtatcattttattttcaagtatataagctatatagtatcaactttccaacaatttctttcttttgctgaattaaaagggcagatagacaataaaaataatagttgatgggtagaggcatcaggaaagtcccttactaaattactttataatgacttacagctaaatataggacttttcaaaggaatattatcttgtgcatttaaaataaatataaaattctataattgaatggatttgactaaataaccacttaacctaagtatataagaaaaaagctcaaattcaaaaacattgtgaattttaaaagcataaaaaagatttgaatgcagcaatactaaaaaagcttaaaatttctaagtgtaatgaatttttgaataagtgaagttcaagaaataaataattatgcatgtatatatgttcgtatgtatgtatgtaactatgcacatgtgtatttattatatatatatatgcaaggttcacaatctcaacaccagactttatacctttatcatgctaatacaatgctggtatatgctcagtgcagagattggttcggcagactgagactcggcatgcctcccatcctaagtctcgattcagtattggtatggtgtggtatgctcagtacacagcagtatgcactagtatggaccttggcaactgcgtatgtatgtatgtatgtatgttcacaagtttggtaatttgtacacttgctaagtttcgcttatatcaaatattaatttcaactaaataaataaaaaacttatataacaaaaaatactctgaacctcctaatattgcattacttttttctgcaaattttcaaataattacgattttttccttttttttcatcaaaacaatgaaagttggagcaaaacttcagaaactgttgaaattgaaagcctaaatagctaaaggaaaccaagatacaagtatctaggataaacaaataagcaaaaggagacataacgtccaacatgcatgacaaacctcttcgaagtttttcagcataatctcgaccacgttgaaaatagtcagcactgtaacttgagggaatattcaactctgatttagctttacccgcaagtcgcttctcttgcaagagctttttagcagcctctgtttcttcgatatttcgtaacttatatctgcagcattaaagaactgcatgtttatgccaggcagtaagaggcctaataatcacagtatatagctaatagaaaaaagagagcaatttaattcttgctgtctatgaaacaatatgctattacactcttttagctaaaacattttgctacaagagtgatatgactcaaagaatgcatattgatgtcattattgaaatcatctctagcacatttagtccatttaggcaaacattacatacaaaatgccactagcatcacttcaacaactatagcacaattgatcgacactgataatatatgtcacaaatcttcagctataaaaacatgtcattcagcaataattatttgttggatcttgtaacaagagatcgcttaatgattttaactatgagtagaatgtggttgtagaaaaaggagatttagactcttaaagacaaagtagccttaatatgtacacatttgcaaaaatggttttgggtgagaattcaatgatattcattgagtaacctaggccttgtttagattggtggcattacatctgacatcaagataagtagccaaatttacatttttgtcaagtccaagttttaaaatttccacaggtaagagcatatctattacttttttaggaacacactttgaagaaatccagtagaagaagatttcaagatgtcaattggtaaatcaactgccatagcatgggtcagacactagaactggagtggataggatttggacatacaaagtgaggttggtcctggaaacagaagctagtttgggaaaaaaaaaatataatataatctgttataacagagatattatattaaatttaattaagtgatgtttcatacaaagttattgaaattgccacagatttaaagtagaaaattccaatgctgttcaagcattaagtagcttgtaggcatccaagcaaattccaattcccacccctctacattgtactgttaagtatcatttcccctttcatcttccctggggatcccagtcatgtgaactattataggttcctcttccaactgttcttccagtcatctcccctgaatgtgcaagttgaggaaaccaacagattctctgagaagcaagtacaaaagacggggaatgtaacgtatggcagttgcatttctcaagtacagtcctaggaaaagaaaccacccattcccacgatggagaatagtccattctacaaggtgataatgaaatcttggtggcctagtccaatcaaggtgcctaaattttgcaaacaaactataatggttgctgcaggtaatgatatcaaagcaaatagttggtcgaaatatcttctatgagtttagtcattgaagctgatgttttctcaaagttgaatgtaaagagtccaaattctattctcgaagcaataatcatgattcaattttaagtcatgcttgtaaatagaaatcttacaaggatagaagccatgcatacatacatttctcaactagcataaacatttacaggtacttataaggaaaatcaaaattacaggcaggtaagaagtagcatggaggagaagatgacaaaacatactcgatgggaagctgaacctcagcaatgccagtggtccattgagtagaactctcttctgagttcctctttttcacctgcaagaaaaccgatcacagaaaaaccaccacttcaatgcgtaatctaactagcaagaaggtgacgctcaaaaggggcgaaaaattctcttttttggtcattattgaccttgagatgctcgggcacaatatagagttcatccatgggatccttctcttccttgtcaccagcatcgatcttcttgcctctcctcttggccaactcctgctctacatacttcaacctttgaattaaagataggaaggatcaaaggatactaatttcaggcgcgcgccagcaaaaagagagggagagataaagacagaaagaaaggaaattagttttgatataaatacatgttggggtcctcgacggtgacggcggtctcctgggcgaaggtgtcctggaggacgaggtcctccttctcgccatcggcgtcagccttctcgccggggcggcgagggacggattcggcgatggggagggcggggatccccggcttccgttcccgctgcttctgaaggaacttcacctcctccaacgccaacctggccaaaaaaagaaaaagaaaaaagagcattttagcctagaatcctcttcgatttcgcctgatacaaaccctagaggcatgcatatgcgtacctgcgctcctcctcgtcttcggagtcagggtcttgctcgaggctccgcttccggaaatttttgagggcatcctccttctgtccttctcttcctttgactctgcacgaacagaaaccccaaggagcttccaatatggaggatggatttcgccggtgattccagaatcggacaccagcaaaaagcaacgcaacggatgcccaccgattattgttgtgctgctcctcggtcaagtcaaacaacgttactaatcctctttcaaggttggaccctatctatcaatacaatgactcaagctgtcccgctttctttcgacggtaccccaaagggcttttaagtccttttgccatcatgtatccctgaccgtccgattgagtccgatcgaacgtggatggctttgattgacccaatggcaactggctgtgccttgcgaggggtagggtgcaaatgggtcaggtcaggtctggtcacgagtgatcccgatccaatttgattctttgattcgatcctaatgttaggttcatactcaatccaataaaagatcggattaggttagatcaagtccatggttagaattttcaatccaacgagtcatttggattggattgagtccaaatataatccagcgtcaatccaaaagatttgaatccagatttgatctgcatcagataaaagtctatagccaactacattttaactaccatacgatcaactactattaattacacaaaataaacagtaataatattgttctcaaaataaattaggatacaaaaataattctgaatatatttttatattaaatatattgttcatataagttttaaatcataacttaaagactcaaatgaatttggatcgtaatgatatactggattcaaattgggttggatcattaaatagaagatctaaaattgatatagaaatcaaatggatagattcacattaaaatttaatgaatctagacccaatcaaaaaaatagaacatactcaattttagaacttaatccagtcccatggattttttaaaatgggtcaaatcaaatcgaagtggatcggacccaacctatttgcaacattagtcaagagtgtttggaaagttacactgataagtattttatgattaggccgaaggtcagaagtgtttaggaagcccttttataccatcttagcagcctgatgccctacattatttttggaggcatggatggtgggaagagaggggttgcggttttggcacaggagaaggagtgcgaagaggaagaggcaaagatgctggagagggagtggatgaagttagtttttagttaactttttagttaactttagcatgacttcctaaaataatcatagctttttaatataattctaaatttattttttttcttttgtgtacttcgattttgactaataatttttttctaaattgattaaaaaaaattccactcaaatttgaatttttaaatttttttctacatgcatcaaattagttaatggctttctaaaaataattattatttcatttataaatgaataatattttttaaataattaagaagaatctcatttatagttaaatttattttttgaaattttcttcaactttctaaaataactctaaatttgaagctcttatgtctagactctatatggctaatatttttttctaaaataattataaaaattatactcaaatctaaattttatgttaattttttttccttttcatgcatggaagcttttttttttttttgaaaggataacttttgaaatcaacattaatatagatttctaaaatatttttgagtcaaatttttaacttaactttaaaacatgttcctaaaatatttcttctatgcgtggtaataacatatttagatatctgtaaattatttaaataacttttgtatttttaaaaaataattgtggagattttagataattattctatgattgtctttcttttttttttttgaattttggaaaggagttttttctctcatttcctttaatatgtaggataaataaggaaaaattatccatttgagtttaaatttaaaaataactacccatctgagttttgagtaaaagcagctacatatttgaaatataacttaaaagtaattatctaaatgaaaatgaaatgacccaattattctggtagttataaagcaatactatactattacaaagtaatactatactacaccattaaaagaatactatactaatataatataatatttttttattataaaaaaatactacattaatataatacaataaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacacacacgcacatatatatatatatatatatatatatatatatattctcaactttagttgattaccatggttgtgctagctttcttatgcttcatattggcgccgcgatgggaatttacctcgaattgctaatcgcaatgaaatcaattttgtattggtcgttgtgaaccgattttcaacaccattttggcataaatttcctgtactagctgcaggataagacggaaatacatacttaccatgcatggtttccaaatattttcttagatatttctattgacatagtaagtgacccttttatcgcggtgattgagtatggaaccttcaagctttcctcatgctttgctgtaaagttgcatccgttaatttagaaaagaatcccaaaaatgtgtatgttttctattatttgatatgcgagagatttcttctgcttctatatcttcttactgatagaaattgtatagaagaggcataaaactgcaatacctgttcatttatataacagaatccgtatctgcttctcctgcatgtgttgtcatccactttctttttctcaaaaaaaaaaaaaaagggaaaatccttctaccctcaattggaagatagtgatatcggttgaatctcactgactaggttgctgtacgagctgcgcggttcgaataaaatctggtcaaatcaaacaacctgaggctcttggaatatctgcagagctgaaatctaaggttgttttgctttcgcgcttttttatcttgcagttcattagtaaagattctgcaattaactgatatttgcctgtcttatgtacatgagactgcctacaccatgaatacttttatatttaaccttataggccacattggaataacctgcttcacttttctgttttcttggagtgaaattctcattattttttcaatgcattatcgtataacaaattcaaaaattattaaccctgagaaacatcagcatactagatgaatttgaaaactgatgcaataggcaatttttcttaagaggctttatgttcatcataacttgaaatttctttatcaagccacagtttgtctcagtttttttgttcaattttgacggagttggactttcatccatacttaatatcaagaaagatagataaggagtggagggttcacacccgtctagaaagtaggaaatattggcttttaaacttccacttggaaagatgcagtaggcatcagttcagtgaaaagtatcattttttcctttgaatttcttatcagatagctgtgggttcaatcttttcaggaagaaggaaaaaagaagaaattttggtcttgcgaattgaatttgactccttgttggcaagagagtcagagacatacctagatgggcacggcaaaccttatataccagccaatcatgttattgctctcatcctcagcatctttaggccaaatatcagttgttcacatggacaaattaagtcagcagatgttgctgtggtttctcttcctgatttggagttagagccctcttatgggagaatgacaacttattgtttcttttgtttcccctcttattagatggtaatcaacatttatgggttcattgaagaatcaagaatgtgcatagtgcgaattaagtaagaaacgggggtccaatacactaatggaaagttgtttagataaatagacccttttgataccctgccacagaaatggtttgcctcctcattctggaattagaatatttcaaggaaaaaatcactaaattcctcgttgttatcaaggaaaaaaattcattttgctttgagatccttacataacaaacaccagaattctgaaataattcccattcaatcaagagagctgcttcaggctttttacaatgccaactaccttgtttgagtttgttattactgtgttgattcctgaatcagggcaaattcaagacactattgcatgtattactatttgatagtgaaggatattattgtagtttagcggttttccaacttttgtatatttatttgctactaccatcttttatcaggtgttgacatagggcttttaaagaccattgcaggcttatttcattctttctttaatgtataatatagtaacttgttgcagttcagattgatacttttttgaaatatttgggaattatatacatcctgtaataattggcttaacatacgacacaagttgcagcagttataaatagtataactaacatttcgtagtccatataggcagcctgaagatcacctgctggtttggacatttgcaatgtacttatttatctttatgttaatttgcagttctgaataggggttactggcaaaatatggtggtcaatgttatagctatgccttttttcctcatctcattactgttttactatttctgctgatctttttctgcatccattgcagccaaccatgttgaagaagtttgaaagatcattaaaattatttcctttcgtttcagggttatgcattactttgtgtaggcttcccatcatcagatattgaagttgaaactcaggatgaggatgaggtatgaaaatccaaagaaacagccgttaaaactatcaaaataaagtgccaagaaagtgaacctgtaaactgtttcttttctttctaaatatggtggacagtttttaatatgatatacatctgtaaatataacctcctttcctttgtaggtttactggctccagtttggacgatattttgcacgaggacctattgtgagttttctgagccttctctctgataagaggcataattagattgcatacatacatacaaagctggtgtatgtatgcataagctggtatcgacatgctacttaccatgtgttttttgcaacacatggtataaattctgtttacttgcacataatttgaattaatatgaactttgtttagttgcacattatatgtattcgtaattgcttccaataaaatctctgtgttctgcagaattttttgaggagttacactgatttcatttcttgatcaattaactactggcttgccatgcaggaacgggataactatgcactggagctggccatgggtgatgaatgattcatgcctaatggattaaaaccagagtctatcctttatacagaggcaagcagtttttcttactctctccaagctatttcagtcctcaacgtacattgcttgtgaacagctgtatttagtttctgtaatcttgggacttttctcatctttgtgacttgttagtaaaaaggctctgttctgtaggtcccatcattcgataggaaagtgaaatcaaaacaaaatgttcaaatattgcattttccagacatcaaatttcacatcctatggcttcatacagagcaggattccattttgtgaaaaactgacagccaccaagataccctgggacatcagactgtgatctgcaatttgaagggttgcttgctgttgcttattggaaaattcagtagaaaccaagtaatggagttggtggtggtttagaaaccagaagcaagtgttttcattagctggatggaactttagtaggaacatgaaaggagttggccaatatttacctctacaagatcacacattttatttttgtatgttgtgcagaaaaataaaaggatcatgtggttagcaacatcattataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatatatatatattatatatatatatatatatatatatatatatatatatatatatatatatatatatattattgcaacagaaataattcatgcttgatttctggttgatctgacagttgaaccagtgacccatgactgttttccggtttgaccaatggtctgagttaacgttgccgcgaggggtacaaaggggtcgtaattgccagttgccacttattgcaacggtatcaatttttcaaattttataatatgaaccacttattgccaccgaacgttttttttttttgggcgttttctgtttttgaatatgaaagcaagcttctgcatttggctcaagtccaaaagcatgacttcaattctagtgtggataaaatcaaacccgatccacatccaaccaattgctactagggattatgcttctagcccaccagctcagtttccctgcgcaccacgaaaagagaaagacgaaaaaataaaaataaaatcaaacaaaaagcctgattcgctggcgaggtggatggcgttagcggggtccatatggcttcactcgtcgccaactttaatttttctagtttttattgctcttcattttaattgcacgggctctctccaatggcttcctttcgactgcttggaagttagtttgctccaacggcttcacccgtctctacccttgtagccatctgcagaattattcgtgcgctctcttttctgaaaaatatgggtgatttaatcaaactcaactcataacagataatcgccacttccagagagctaataagtttttatgcgaaagagaacaatctattcctcatgcaacaatacaagtagctttatttaatcaatgggtctaaccacaattctaattgaaaacaaccaaaaagatgattaaatgctgtccaaaagatccgaattaaaaaagtcaaaatttccatatagatcaagtccttggtacgcatgaggggaattgttgaagcggaaaaatcctatatcctagttataattgttatctcctaccctcaaggtactattttcatagtattagttagcttgctaactactttcatggtatttttcctccgtttagttcaaattctttgtatttggttgggattgtgagagaaatattgaatagagttgggaaaatagataatctccatctatcatttggttcaaaaaattttaaagaaatggatgaaaatgtataattgtccatccatttagacccatcaattttgcatccttccaaattatgggaatacaaagaaagttggatagaacatagagggatggtttctacattgaaaaattatctcttattaaccttttgtaaaatcctgacacttttttacctttttatttattttatttatatatatttattttatctatattatttatcttaatatctggacacttcttcatttttttttatttattttatttatatatatttattttatctatattgcttatcttatatttttaaatttcattatcaattttttaattttaacatataatttctataattataaatcaataattaaaattatactctatttttattaatattcattattttcagttaattatttatataaaattagttaactacctaaatcaaattataaattaattatttattgtataatcaatatataaatagttcattcatatatattttatttactaaattaaattaaatatttatagatttataaattttaaagattgtaccttgtatattgctctacttctttaatttctataattataaataaataattaaaattatactctatttttattaatattcattatttttaattaattatttatataaaattagttaactacttaaatcaaattataaattaattatttattgtataatcaatatataaatagttcattcatatatattttatttactaaattaaattaaatatttatagatttataaattttaaatttgtaccttatatattgctctacttctttagtatttataaatattataaattattaataataataatacttttatcaaaggatagttttagtaaaaatatctataaatatcattcattctttctttcatttctcttgtattaaatagaggagaaaattattttcatctatttttttatattttaccaaatatatgagaggatgaatggaagattcatctataatcctcctcatccattcttctttctcgatccatcatttttttaatccatctttcatatcaaataaagaaaaataagttcagagaggatggatgaaaaggacagattttccatccatcctagatcatcaatttccatccttccaaattgagagaatataagaaaggatagatagagtattatgaggataaatttctatattgataaaattatctctcattaatttttttaataaaactatattataattttttatttttttatttaagtttcatatattatttttattttatctatactattaatggtataattattattaaatattattactaattattttaattttaatacataattgttataattataattaaataattagaattatattctatttttttatttatatttactatttttaattagctatttgtataaattagttaactatttaaattagattataaattaagtacttatttatataattaatatatataaattaatttattaataactaatttataaaataatttatttaatttaattagattaaaattaaatatttatataattttttatataattagatattacaaagattataagtatctatattatttacttctttagtataaataaatgtacttataaatcgataataataaaaatatttttattaaaagatattttagtaaaaatattatctaaatatcatccatttttttatttattttatatcaaatagaagaagaaataatttttatccattttttcatattttaccaaatatgtgagaggatatatgaaagattcatcactcctctctcctatccatcctttttcctctatctatctttcctctaatctatctttcgtatcaaataaaggattcatgtgcagcatatttacctgctaatagtggtgcatgttagttgagctaaggtatgaggttgcttaggcttccctcaataaatatgattaaaggagcaacaattgagnnnnnnnnnnnnnnnnnnnncttctccaaatattgtgatgttgctaattcagattgctgttagatgtatgccctagaagccagattggctgacacttgtaaaatactttgagagcataatttataatttaattttgatattaataaaattaaattattttatttatattatatttaataatatttgtaaatcatccattggattaatgggtaagataatacgtattctcaagagttgagaatttgagacatgtgctaattttagttaactcataaattgctctcaatcgtaggatcatcatagagatggtgatcgatccaaaagattgatgtacgatcactctcttcggatagatgagtcttgattttatggtgtgcagacaccgaagcgaaagtacaggtacttgttaagaacaagagtactggacgtgaccatttacgaacaatcacaaggatatctactttttcattagtggcatattcatagctgcggttgtgtgtttagttttttgacctgaggtgcatcgacaattcatcttgagggtgctatagtttgactacaccataattcgattttctagccatacggagtcttaaggtgtatgttggctgtagtatattcattgcagaaattaaattgcataaagatgaaatctatcgatctcgatagaggaggagtagtcctatataaattatgaaattgagtccacaaatctatagccatgacagtgtgaaagatagaaaagagtttctattaggtttcacatcagacttgaatcaagtgattctatcatatgatagatatgaggtttgacaagtttatcttgaccttaattctgttggtactcacgattgaagaaccgaatcacatggtaactatacttagagattcatctttcagttctactggattgccactatatactgctagatgttactgatagattatgagatcaattagaattattttgatgatcgataattctaattagctgaattgaaaagagtttcgatttatcgaaaagagtttcgatgatgttattgatagagatcacaacatatctcactatcagataaaattagacctatggggtcacagaaatatgaattttgatcttggattgcataattagactaagtgtagtttaattggattaggattaattgagtcctagctttgagtttaagggagttatgctagcacatagttaaacccattttctcctacatgatttgggtttcctattagataggatttaacctaattaaagcaacctcaaattggattccaaatgttggttcaccaagattcgatttgacctaattaaattggctttatggggcgtcaaatgttggcgccacccaatgttgttcggccatgacgagggctcacacccatatggatttgatccatgtaagtcatccaaattcagataagagagagggagagggataagccttatctactagtggatgaggataagagatttgatctcctttgaatttaaatttagatttgaattcaattttgaatttaaattgtttgaattcgaattgaaggtggattggaatgaggcgacaacaaccttatcctatctccgtgccaatctaaatttttcattgattttatgtgacaaaacaagggagaaatcagagtgaggtggatctagaagagtcctattttaagacatatgatttgatcagattcgtataaaaagggattctttttgattgaccaaagagattacagctgatcaaactttttccgtgcctcctctcctccattccatgcctcctccctcttctatctctgatatatgaagcacttccacgtccaagggtgttggacacgctatttagtgggttcgaaatgtcgaaggctgtcaaatttgcatcaagaacgagaaggctgtgatctagcttcgatcggagtcctgttggagatcagatttgaatctgatcgaggagcttgctgatctggctagaagtaatcagttgaagaaggagagagcatttgataccaggtctgagtggatgcctatagaggtcagtcacgtgcgtagctcaacagcgaatctcgagtattctgatcatcagactacggtgttcttctacccgcgcaaggtgatatgatcatcctatcatttgcatgctgttttatatttatatgctgatataaatagttcatggatctgatttagatctatatttggcgtgtcggatcgaatcaaaaatttttgaatttcgctacctctgatccaaaccaattcggtgcaccacacgatccttcgactggtatcagagtcagattattcagatcataaatttaaattggatcgaatttgattcagatgtgatctgaagttatgatcagatctgaaaatatttagattagatctaaatattacatgtttagttagatctaaaattattttaaattaaaatttagcatgcggtagactagatcttattgatatatgtgatatatgcatagatctagtttattatctgagtagccaagtattcggaaaagtttatcatcagatcgtctggtcataagaagaagcaaggaataatccctctcttgtccaatcgatggattctcttatgaagtgtagggacaccatatggttatatcccataaagaagaacagtgaaaagaaatttgtatttgatacatgtttagattttgtttctagtttgcatatatgatatttatttcgatgtgttttggatcaattattatatatgtgatatatatttggtttgtagaatttagatctaaaatttaatttttacaaaatcttagatccaaaattctagaatcaaaatctaaaattttataaaatcttgaaacctgctgctggcacgtctatcgaggcaacttagtcctttttgagtcaacttagttccctggtgggtcggctcagtttacaattgagccgactaacttatcaagccacggttagcgagttactgtttgtcaccagttagtcggctcagtcctgtgattgagctcactcattgtattgagccgactcaattccaggatgactcgacttagttctgtgaataataatttttgtatgtgatacaatggaatataatctaaattatttagacatatgacccatgaacttaattaggaattaaagatgaaattaaaagatctaattgaaaattcagatctgacataatttcataaatcatgagttcagggtgtgggtagctcaattaagtctagtgggagcggttgatcaaactgactcaaaagtttattaggtttgggtcaagagtgcttcagaccaatctaatagttgtaagtttgattagatcgattcacagccatatgttatcgatcaattaagatctaattcggctcagtgattcgagtctggatcaataggttaacctgatcgattctaatcaatcaatttgatgtctaaggtaagtacatagatggtagttttttaattaattccgttgtttgatctgaccaactacgttggtgtctaagaaaagtaacggggggacccgcacacatcttaacttggctattttgggagattagtttctgtattagatcaacttgttgaacttgtgctagtccatgccactagattagttataaccattatgactaattaaggatgagacctaaaataaatctttctaataaaatattaagtcttacgattttctatcattgtagttgtgtgggtcctttacagggttgattgttctcgactggatacagtgattcagttgcatcgaaaagatgcaactataactattagacatgagatgctatggattggagatgaggttaggcttgatattttggatacgataagagtctcaatgacggatctattttgtgcaaatgatgggtctgacttaactgagtgggccaatattttggatacagtaaagctcataaattagagatcgaaggtggctgcaatgtgtttagagaaacattggacaagagtcattcacttatcaaatgatccaacatcaataactgttagatgagatggtgagtcaattggtgagaccgtagtactcacttaagactcttaatcgtggaggtcttcgcttctcttctaaaggagtgtggagaatcaaaaaaataggagccctaatttattttaaaaataaaatttttaaaataaattgattaagttaattacaaaatttaattagaaactttgactctctgcaggaacaatgtctgcttccaatctcctaacccgtatcttagaaatcaatagattgatcggatcaaattttaaagattggttccaatacttgaaaatcattttgagttccaaaaaattagtttatatccttgatcaggacctttctcctctcccaatccatccaatcgttgatcagaaagcatcttatgagaaatgattggacgatgataataaagttaggtgctatgtattgacgtcaatgtccaacgaattacaatactaacatgaggatatgactattgccagacagatgctgactcacctacaagagttgtatggtgagcagagctatacagcttgctacgaagtatccaagtgactcttcaaaataaagatgcatgatggacagttggtccacgatcattgtttgacaataatcaaagatcttgaggagcttgagaagctcggcatatccatggataaggacttgtaggttgatctgatcctgcagtctttgactgattcatatgaacagtttattataaactttcatatgaataagatccagtacaccatctacgagttggttaatatgttggttacaattgagggaaccttgaagagtttaggggctctgtacttgctatggagtagatttttttcaagagaaagtctactgagaagaagataaaatttgcaaaaaagcaggtggagagcaagaaggagaagaaggcagtcttgaagaagaaggtcgtcgaaaagagaaagtatttttactgtgacaaagacaaccattggaaatggaactgccctacttacctgacaacactgaagaagaaggaaggtggaccttttggaggtatgctcgtcatagaaataaatctgacagttttttctacatccagttggatgtttgactctggatctagtgctcatttgtgcatttctttacaggatcttgaggatagtaggaggttaagggatagtgaaatgattctatccattggtaacggagcaaaaattgctactatggtcgtgaaaacctatcctctacgattactaatgaaaaatattttaattttgagaaactgttactttatatctactgcgagcagaaatctgatttttgtatcttgtttaacgcagaaagactatataattaatttctttaaggatcattgtgctatttatttaagaaataataaagttagaaatgattttcttattaatgatcttttttagttatatgttgatatttctgttcattatgtcgagcaaaatgtgaatgctataggttctaaacatcttagagataatgtgaacgaaaagtacttgtggcacctaaggctaggtcatgttgccgaagataagattaacagattgaagaaaattggactactgagtctattgacttctgagtcatattcggtctgtgaatcataccttcaagacaaaatgaccaagctgtcttttgtgagacttggggaaaggatcatagagtgacttgctctggtgtattctgatgtttgcagcctatttgatgtgtcggtcagagaagattttatctattttattatctttaccgatgatttttgacgatatgggtatgtgtactttatgtgtcataagtctgagacttttgaaaagttcaaaaaattcagacatgaagtgaaaaaataaatcaaaaaatcttttaaggctcttcgatcagatcgaagaggtgagtaccttagtgaaaaatttttgaattatctcaaaaaaaatagaattatctcatagtggactccacttggaatgcctcaactcgatgggatttcagaatggagaaatcagactttattagatatgatccgttccatgatgagtttcatagatcttcttgattttttttgaggatattattttgattgccatatatgtactgaataaaatttcatctataatcgttcttaccacaccatatgagatatgacatggtaagaaatcgaatctgaatcatctcaagatttgagattatttaggactcagtttatcggatatcttaaagaatcgttaggatattatttctatctttcgaaagatcataatgtgattgtgagtcgacatgcagttttttttaaaaaatagtttattcaagatggaggcatagaaagacaaattagacttgaagagaaagtcttcaaagagcaatgagccttagaacttgaggaaccaattcagtttgagccgatccatatactttctccttcatctcgtaagtctagtaggattttctgtcttccagaaaggtacttaggtattatcttagaggatgtagaaaaaatatttctcatgaaaaatggggtacatggagatgaccccaagatctataacgagatgatatcagatatcaactttgagaagtggttagaggcaatgaagtccgaaattgactcaatacactcaaaccaagtctggatcttgatagatccacctgaaggtattatacatattgggtgtaaatagatcttcaagagaaaatagatgtagatgtaaaggtaaagatctttaaggctagactcatggcgaaagggtatagtcagcataaaggcattgactatcagtaaaccttctcatttatacctatgcttaagtccatctgtacattgcttgctgttgcagtgtattttgattacaaaatatgacaaatggatgtgaaaatgacttttctgaatgggtatcttgaggaagatatttatatggaatagctgtttggttttacttctagtgatggtgatcacaagacgtacaaactgcaaagattcatttatggactaaaataagcatctcggtgctagaatgcttagttcagtgatgtaattaaatcgtttggtttcatcaataatgaggagctgtgtgtattcaagaaggtcaatgaaagtgctatcactttctttgtattgtacatagatgatattctcctgattgagaatgatattctcatattgacctcgatcaaaatttggttgtttaaagagttttgtatgaaagacctaagagaggcatccatcattttggggatcaaagtctatagagatagatttaggaggatgcttggactatcacagaagatgtacattgagaaggtgctgaaaagatttagcatgaaaaactctaagaggggtctagtacccttcagatatggcattcatttctccaaaatgatgtgtcccaacacatcgaaagagattgaatgcataagcaagattctttatgcttccgttatagggagcctcatgtacgtcatactttgtacacgacctaatatcgctcatactgtgagtattacaaatagatatcagtcgaatccagaggaagaacactgaacttctgtgaagtgtatcattaagtatttgagaaggactaaggatatattcctgatgtttggtaatggagaactgaaggtgcaggggtatactgatttagacttcatatctgatatcgatgatcgaaagtcgatattgaaaagtatttttttgtataatagtggtgttgccaattggaagagttccaagcagactgtgattgcagactccatcatggaagcagaatacatcgccgcattagaggctgtgaaggagatgttctggttcaaaaaatttattgcagaacttggagtgatgccatcagatgccgtccctctctactatgataacaatggcactatagttctaactaaggagctgaggtctcatcagaaattcaagtacatcaagcgatggtttcacctcatccgcgattaccttgagaaaggatacatcgagatgaagagagtcaatactacggacaacgtggctgacccattgacgaagtcgttgagctagcaaaagactaaagtccaccttgagaagatggaacttagatttgtagccaattagctttaggtcaagtgagagtttgttagatgtataccctgaaagtcgattgactgacacttgtaaaatatttgtaggatataatttataatttgagtttgatattaataaaattgggttatttttatttatattatgtttaatagtgtctgtaaatctttcattgggttaatgggtaagataacacatattctcaagagttgagaatttgaaacatatactaatcttagttaattcataaattactctcaatcataagatcatcatggagatggtgatcgatccaaaagattgatgtatgatcactctcttcggatagatgagtcttgattctatggtatgtagacatcggagtgaaagtataggtgtttgttaagagcaagagtactgagtgtgatcatttacgaacagtcacaaagatatctaacttctcatcaatatcatgttcatagctgtggttgtgtgtttagttctctgatatgaggtacatcagtaatttatcttgagggtactgtagtttgactacattataactcagtctcctagctatatggagtcttgagatgtatgttggctccagtatgttcattgtaagaattgaattgcatcaagatagaatttatcgatctcgatagaagaggagcagtcttatgtaaatcatgagattgagtccaaaagtccatgtccatggtagtgtgaaagatagaaaattttttttattgaatttcacatcggactcgaatcaagtgattatatcatatgatagatatgaggtttgatgaatttactttgacctcagttttgttgggattcacgatagaagaatcgaatcacacgataattgtatctagaagtttatctttcaattctgctaggttgccactacatattgctgggtgtcactgatggattgtgggatcaattagaattatttcgatgttcgataattctaattgactgaattgaaaagagttctgatctatcgaaaagagtttcgatgatgttgttgatagagatcacaatatatcttactatcagacagaattggacctatggagtcacacaaacaaaagttttagttttggattgcatagttgggctaagtgtagtctaattggattaggatcaattgagtcctagttttgaatttaagaaaatcatgctagcacatggttaaatctattttctcctacttgatttgaattttctattagataggatttaacctaattaaagcaagctcaaattgggttctaaatgttggttcaccaaggttcgattttgacctaattaaattgggtttacgaggcgtcaaatgttggtgccacccaatattgttcgaccatgatgagggctcacgcccatatggatttggtccatgtgagtcacccaaatttagataagggagagggagagggataagcttcatccactagtggatgaggataagagatttgatcttctttaaattcaaattcagatttgaattcaacttcaaattgaaactgtttgaattcaaattgaaggtggattagaatgaggcgataacaatcttatcctatctccatgccagtctgaattttttattagttttgtatgataaaacaagagaaaaatcaaagtagggtggatctaagagagtccttctgttttaaggcatctgatttgatcagattcgtataaaaagagattctttatgatagaccaaagaggttacagctgatagaatttttttcacgcctcctctcctcctttccatgcctcctccctcttctatctctgatatctgaagcacttccacatccaagggtgttggacacgttgtttggtgggttcgaagtatcgaaagccgtcaaaactgcataagaaactagaaggctgcaatctagcttcgattggagctctgttggagatcagatttgaatctgatcgaggagcttgcggatccgtctaggtgtagatggattgaagaaggagagagcatctcagaccaggctcgagtggatacttgtgagtcggacgtatgcatggctgaacagtgaaccttggatactctgattatcggactggtggtgttcttctattcgtacaaggtgatgtgatcaccctatcatttgcatgttgttttatatttatatgctgatataaatagtttattgatctaatttagatctatgtttgatgtaccgggtcggatcgaaaatttttgaattctactgcctctgatctgaaccgatctgatgcaccacccgatcctttaattgctacctcacgtggacctcctctctactttgcttggacctcctccttctctgcttgatgccacctctcgtcggtctccgtcggtctcctttcttatcgagctctcacgaacggccacctccatcatcgccttccttcctcacggatctccacccacctctatccatcttaggtgctttccttcccatatattcgaaaaaaaagagaaatagaaagaaaaaaaaagaataaaacttaccaacacaaaaccttagccaccaccatcgaagcttccatattaagccgctccaagtctcccaaccaggactgctgaccgccccccacaccctccgtggccccgcctcgtcgctatcccctcctgttccctctcccggccctagtgaactcgagcccctgcagttgtgtgtgagcaccgacgaccgtccgcacccctttgtccgtgctcctccctcaggtgctttccttcccctctattttttttcttcggtagcattttcatttttttttgcttcaagcctcgcagatgcccactttcacagtggatgaggtggagccatggagcccggggtggggaagccacgagaggcatctgaagctggggaggggaggtgaggggggttggtggcactgaagtcgggggaggggagggggccgggtttggtggtgccggggtcgagtgtggcatggatggtggtggggtgcggccgctacgaggatggcgcggacggccacaacttgggcctcacatggcaggggcgggggtgggggggaggcggcgggaggaagagaaggggaaaaaagaaaaaagaaaaaagatatctgaggagcgagaggaagaaagaaaaaaaatattattattttattattattattaattaaaaatattattttcttacctggctttggcaggatattaaaagagggatggtcggctgtgcatggtaaggaggatggtggagagcttggattagataggagagaagaagatgcatcttatgttgtaccgaaaaatatataggagaaaaaaaatgaatttggtagggtattaaattaaaagatggtgtgagtgggcaaatatgttgacatgtccgtgttttgttccactatatcataatgagtgaaaaaaagagagaaaaaaatagaaaaaaaattatggagcaggttggctataacctctcaaagggtcacccccaccatcccaaacccccggtactgttttacttcaaaaaaaaaaaaatccaattttggtagtggtttttgtaattattttgttgaaattaatcattcactgatataagataataaaatttaagaaaaaattgttatttcgcaggcttatgcatatctgcatgtccgtaacaagaaattctcctgggttatgctttgttatctttctttccttttttgtcttttctgaatgattgttatgataactagtattctattctttatattgtgtaattatcatttgtgaaaactgatagaagaatttggggccagtataatgtatatcttttaaatgttggaaatgcttcttttgatatgttgttgatgttttattgatccttttgtatgatgttgaattactatgcagttgatattctctgaattgttgtttcagaaatccattttttcaattatttgagtaaaccatgagggcatgtgttatgcatttggaactcaaaagttgtaatatatattaacttctatttaatagatacatgacatttccttctcatatgtaagatgtgaaattgttctttcttattcattgttgcttctttttgcactgttgcagaggtctatgtttccttaatttcatgttaattagttgcttcacattatttttccatcagtataagcacattaatatttctaactgtcaaatattatatattataattctgtaaacaacaacatctgaataattaaaaataagatagtaatatttaaaaaattattttcgtacttccgatcccgtgcaacgtgcagatcttcgactaatttgctaaatagaccgtgcttggacaagcttgtttttggatggggtagaacttctctttgtttttgcaaacccaaagtgttcaaaattagcttaaatattatttaaacaagatcaatctagctagttatcaaactaaatatttaagtagtaatttacgaatatctttgcttgtctttcgccctattgacaagctactttcccttaaattttctaggcgtcgtgtttttctccataataattgctacagtgaagtaagttggtgcatatagtgttggtatgttgtggaaacctatgctctgatgattaccattgcatgccttgtgagagccacgaaccagaagatcgctcattgcattttgtgcatgtgaattggatcagatgatcatcgtgggagctggtctccagcctctgcaagtatttaattagtgagttttgctgggatacttttttttataatattttattataaaaaatatttaaaatatttcatattattatttttatattttttattttttaaaaaataatatttttttattattatctttttcttcttccttcctatgcccgaccttgcttcttcggacccgccaccccctccaccccctgtccgtgctacctgcgcctcctctgtcccccattggtctgtccatggctcctctgcccttgtgcctcctctctggcaccggtggcatcggtgctccatccccctatgcgcgcctacggttcccacccccctccggccccccttttcgatgccccgtagttccaacccctccacggcccgtctctctggcacccgtggcttttgcgcccagacccccccctccgcccccgctagtgccattggcttctgcgtggcccccctcccctggctccgccccatgcgtgcccgcaattcccacccctctccaacccccttctcagacactcgcggcttttgcaccatccccaccctcccgcctcgggccccccatctctaatgtccgcagcttctgcaatactcccctagccctgcacacctgcggttcctccacctccgacgtcggtggcttccatggccccccacctcacgtgtgcttgcggttccctcgactgactgctttttcgcgccaccaccatcccacccacagttcttttgctttcgtggccgacgatgaagattttttagaaaaaaaattaatttaatcgtgacatgaattaatcgtaatctttgaaatatttatcgtatcaatcatgcatatggatactttaattagttgaaatctaaataattcatgtttaatttaatgataaaaaatagataaacaataaaggaactaaaatatcttccggagtactatagtaaaattcttaattaggacatgtattacacatgcttaaaatgaagtaaaatagttaaaaaaaagaaaagaaaagaggaatgatgttgttcaataactaaagagaaaataaaggaacgaacttgctctggtaagggtaaggatgaaagtgttgtcggttagaaagtgaaaaagcaaaaaactactaaagatagaatcatgctggagccgatcgcccaaaggatgcagaggcactccaacagttttaaagatatagatgctccaagttgagctaaacgttatctgttaccgttgctatcaagttgcagcagaattccattctgttgagtaactttctatattaattagatattttgttttccgagaagaaaatctttttacctttaattttggtaattctctgcaaataaagacaaggaaactcaattttacataaaagctaaaaaaagggaaactctttttactgatttcgtgcgtgatgcatggctatcacgtggaaggtactacaatccaatcggcatagtttaagggtaggaagctgccccgcacgacactgagactcaagcgtctactcaaactggaggttggtactagcaagggaacaaaaaaaactcccgaaagatacgaggtacaaaccgtaaagttactctctctctttctctctccgtgttgataaagatggctatgatgcagccgtcgacgtcgccgccatctaacggcctaatcgacactggaaagacgtacgcaccctttaaattaccctctcgtttttcctctcatgctatccactgattcatttgaaagataagaacgtgaaaagccggaggttgcgtctttcggtggccatgcacgttattacttatccgttaatatttacgatgatattacgtcaaatttattataaaaaaataaaaatatttatatttaataaaatattatatatttcatcaatttttataaatgatattccatattcaccatcaatttctgatttttgattaaattataataattttgacgtaatattaccattgcaatcaatatcttttccacgtaacgatctggtggggctagcatatccaatttcaggtgtaacataggtaacctcctctttggtcctcttgcatgccttcgtactttatataaatcatcctccaccgtgagagctctcaccattatgcagctcggatcatcgatcaacctttgattttgttgatatatacacatatataacacaaccatccatattgttacgtctcactatatatctagctagttcgaagcaggatcatggtggagaaacgagtcttttgcagcctggttctctttgctctgttggccttccgtcatggtagcaccggcgattcgtcgagcttcgcgaggaccggcggcacgcattttgtcgtgaatggggtgccgttcttctcaaatggatttaatgcgtactggctgatgctcaaggcctcggacccaacgcaaagggacaaggtgtcttctactttccaacaagcttccagctttggaatgagcgtgatcaggacctgggccttcagcgatggtggggacggcgctctgcagtactcacctggttcttacaacgaggaaatgttcgaggtacatatatataatgcccatatatcatatggcaacttcttctcatcagcttaccgtagccgaggagcatataaatctaaatacttggttgcatgagttcattaatttctttttacccaccaactagacatgtaagttttatgatagccggttatacgatcaactcaatcttaattgccacgcatgcagctagcttttccaactcatgattatgctctttgcatatgtaattttttgttcaaaattaagaaagtatgcacgcatatggtatgggtagatatggattgattcatatatatatatatatatatatatatatagtaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgatacatatgtcaaatagaggctctgccaatgtagaagcctccattttaatacacacactagattatcgttggatattgaatagtatatattttgctaaaaaattctaaaatcttgctcctcaatcaccagcccttgtgcatgtaatcagccctcttcaaataacaccagggatggcaatcaggtcaagtgaggtcagatatctttctatgatctgaatgcatttatgggaaatctaaatctttttaaagtgagtcaatcgtggattgagttgctggcttgggtcctaaattattaaacctaaatagcacctcttttttttaaaaaaggaaattaaatacatccctgtacctagcacatgcttctttacggcaagcatttggtttatatttttaccaaaaaaaaaaaggcaattcatttatgttaaatgcatgaaattcatggatggaagcagtaaatttaaaagagcaaaaggaaatactttgtcagatttgcaaccgccccttacatgtatcttgtgctatatgtcgtcaattcaaagcttttcagagcctctggatgctccactccaaagagtgggtaaaaggaaaaattaaaggtcaaccatttcttcatcgacctcttgttcgttgttctgctattatatcatgctgttacactggaagagcccgtcatctgatcgatgtggtcagtcgtctcacggccctagctgtatggacactattggtaggacagtgcaaaaggataagaaagtgggaggaaatgagtacacatttatgctcggttacatgacaagatatttgcactgacaattaataaagccctaacctttgttaggtacactcccaactgagttggaaacagaacaagaaaaccactttgttatgggaacaggtcaacaaaaacactcgaaagctcagctccaattgcatggcatcgatccaatcctcaacaaaagaagagtcaggttcactcatcatgttggtaagagtgaaggaattcattaatcagctgagtgcaccagagatctcagactcctccggagcttatcatggctctcaagcatcttgagagagctgatgtgcttccaactatggaagatattatggtatagaagaaagaagatcactggttctacattggttagagttaaggaaaaatttagcttatatagaaaggaaccattttttccatctgagatgctttttaaagaataaaatcatgaggctctcaatgatcaaggcttactgaaacccaaagatgatcatgagccaaagcggacaatacttcatgtgtcgagccacgagtctttgactacaacatgcctttaatagaatgtggggggctcctttcacctaaacaccattctgtagagtacacagattctcctttcactagagaggttatgttcccaaagatggtcacgaactaaaatgaataatacctcatgtatcgagtcatgagtccttgactgcaacagaagggagggatgtattgctttttgaagaacaatgtagattgagcatttcttcttgagtaatatcccaacgttcttctcctaccaaacttgccaaccaactgccgtcatcagttgatcaactgctcttctgattgatggatcaaattttctcttcctccagtctatccagggaccatgcaggtttgagggcccttgcaagaaatatgtagagttatcaattatccatcaaaccagtccatttcatgatttaggtacttgggattttagacttcaaacataacctcctcttgttgttttttttttttttctctcttttaagagaagggaagtagaagagttacgacccgacttctattaagatgagtaattgcatggagggtggggcaaaacaggagatgaaggctcctctttgacaacagagccctcctaaaacacccacagggttgtccacattgatacagaacgcagagtgcaacaagatttcaagttgagaatacaaagacacaagattcaggagttttgagaatcctaacttcacaaggcacttccaacctgtcgttcggtttgagggattagcagacgaaatagacgaggttggcagcagccccttcaaagtgttccataaggcagtgtgcacaacaatacttttcctagaataagacgttctcccacatttggtatgaaaagagagttctttacagaacagagtacatagatgatctctcttctaagaagatcctattgttcctttctctccgtacctcccaatataaagcagctatcagttgatctccagatcttctcattgagtccgaattttttttttctcctccaggaggtccaaaaatcattaaaacaggcagtccaatctctgatactaagttggattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncataaaccactatgacaacatgagcccaactatatatgagcccatatatgaactcaacgtaccattaaaccaaaacttatataacttagaaattaaaaaagaacaaatattacattttaatactcccctttaatgattgtttttgaatgcctatgagatttttaaagtagatgaatttctctttgggtaatatcttggtgaatatgtctgctacttgatcttgagtcttcgcatacttcacttcaattttttttcttgtactgcatcttttatgaaatagtacttaattttgatgtgcttggtgcggctatgtagataggattctttgtcatagagatagtaaacttattgtcacaaagtagtataatagcttcttcttgcttctcatccacatcttctagtattcttctcaactaaattatttgttatgctgccaaagtagttgagatatattcgactttcgtggatgacaataccacaatgtcttgcttctttgatgttcaagatatgacatcggattcaaaaaagaatgcacagcccgatgtgctcttcatatcatcaatgcttctagtccaatcactatcacaaaattcaaataattttatattatcatttatccttctttcatatatgatgccataatctttggtgcctttgatgtatctcaagactctttgtgccactccaaagtgaaccttacttgacttttgcatgaatctagaaagtaaatttgatgcaaaaaattatatccgattttgtagttgtgagatacaataagcttccaataatgcttttatatagtggtgcattggcttcatcactttcatcttttttcattaacttctcatttaccatcaaaggtgttactacaatattgtaattctccgttttgaacttcttgagaatgctttctacatactttttttgataaataacaatactatcttctctcagcatgatttcaatttctaaaaagtaatagagcaaattcatattatttattcatatcttctcgtcatttcacttttgaaagtcaaaatcatattctcattattaccggtaatgatcaaatcatcaaaataaagagagacaatgagaatatcgttaccttacttcttcatataaagtgttggttcacttgaacttctttaaaaacttttctcattgaagttggcttcaatttgagaataccatgctcggggtgtttgcttcaactcacacaatgctttcttcaacttgtatactttgctttcttgacctttgatgatgaagccttgaggttgttctatataaattttttcctccaatatcccattcaagaatgctgactttacgtcaagttgatgtagtttccaatctttgtatgccatcatagaaatgagaggtctagttgtgtcatgttgagcaatcggtgcaaaatttttttgataattaattctggatagttgagagtatcctttttctactaattttgctttgtatctttgaatggatccatccggattgtattttgtcttgtagattcacttaaagccaatgattttcttgtcatttggtttctccactagctcccaagttttgttcttctcaatcacatcaatttcttcttgcattgtcttattctatactacttcatgtatagcttcttcatgagttttgggctcaatcatgcaaaagctacaagtgacataaatgtcacttaggcttcttattcttataggagtggaatttggagataagcttgagtttgaagttggtgatggacttacactttgagaagtttgtggtgaaccttcatcttcattttcttcattttggatatcatgaatttcttcattaagagtaataatatttttttaattttttatccttccaatcctaagtagcattctcattgaaaagaatatctctttttatgatcatcttgttgtgcttcgaactaaaaagtctatagccttttgatttagaactatagccaacaaaaatatatttttcacttacttcatcaagtttgtgccttctctcttttggaacacgagtatagtatatacatccaaaaactttgaaatgcttcatcgaaggtcttctactggatcaagctccaaatagtgtcttattttagagagtttttgttggatatctattcattaagtacaccaccgtgtacaccgcttccatccaaaaaaaatttgaaaggcctttgtctttaagcatagatctaactatctcaaaaatagtacaattctttttttcgacaattctattttatttcgctgtatagctaatggtcaattatctttgcaaaccaatatttttataaaatttttcaaatttatttgagttatattcaccacctctatcacttcttagcaccttgatgtagtgctcactttatctttccacaggatttttgaactttttgaagatgatgaatgtctcaaacttatatctcataaagtatgcccatatcatttttaagtagttatcaataaagataatgaagtaaatattactgacatgagaagaagtttttataggtctacatatatcggtatgaacaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttgtcatcggtcatgtggttgctacatccattatcaagatactatacatcatttatttgctcctctgtgatttaatatgcgtagaatgtgctttgatcgcctttattttctttgaagaagtgtgcctgctcacttgtttgatatctacaatctttttaaacatggccaaactttttgcaattataatattaaattttttttctaaacttataatcttttttaacataagaagatcttttacatatgttgcatctaggttgagtgctcttatcattttgacttcttgaaaagttattttttttcctctcattttcttcctcttcctctattttgatttctacttctagatgactctcctttaacttgtgtatgactagacggttctctttgaggacttttgtcaaacatattgagcttagattgaaaggcactttctaatgatgattctttgtgcctaaacaatctttactcttgagcttcaagagatcctatcaactcatgaacacttaaagtagaaagatcttagattcttcaacaatagtaactatggtatcaaaatttgaaggcaaactagccaaaattttctcacatattctttgctcgatgatggtttcaccatagctcttcatttgattaacaatctccatgattttagggaagtaatccttcaatctctcatttttttatattcttaaattatctaactctcttcttagagtttgaagtttgatagttctcatattggtgttttcttaaaatttctcttacaagatgtcctattttttttttgatttggtggctctaatgattcttaggaaaattttgtcggacatcgcttgttggatgaagaagagggcttttgcatccttctttttatagtctttcatttgctctctttgttggttggttggagtggatgactcttcatactcactctccactaaatcttaaatctcttatgcaatgaagatggtcttcatcttgatacttcaataaccatagttttctctataaaaaataagaatagaaggttgattgatgtttatacccatattgtttgaatttgtcattaagaacttcttgaatagtgctctctttcccacttgttgtcttcaaattcaaattttgttgatcaaccttgctctaataccacttttgttggctttgtttactaacttgatgaaatttaggaggagattgaagtagagaatgagatgaaaaattgagagagaatatagatctaggtatttttttttcttttttcttagtacacaaggtcatttatgtgtgaggctaccacattttataaaaattcatacatcaatacataaattactatgataatatgagcccatatatgaacccaacatacaactaaaccaaaacttacataacttaaaaattaaaaagaacaaacattacattttaacacatggccattgggattatagaatacagtttctcataagaaccatcaagtaaagatcgatgaataaatcaataaggggggtggatccaacccaagtatccccctcagaatctgatcaataatctatcaccaagtttataggagaggcaggttcaaaatgcactcaggtgtttgttcacatccttccgaattggggataaaccggaaatgttccttgcaactctcataccaaggtgccttctcgaaagccatctttgatttggttccaccattggttagatgatctggttgcaaacttcaaagcccatttagcaagcaatgctatgttcatttgctcaagattctccacacccaatcctccatgttcgatggatctacaaacatggtctcaattttttttcttttttgatggcaaatgggaggtttggtctcctaatgttaggagatcaaccaccctaatttttttagataatgtgtaatatattataaaaggtatttacagctaatgacaaccttgcttgtttttctagtagttttctaagattataattatgtacgtattcttcttctaatacactaacaagtaatgcaatcttagctccttgtttgaagttgtgtaattttctcttctaatatgtcctttactttttctttatagcatgagatccaattgcttagtaggaagattgagcggttgtagattatactatgagagagagcttcaaaccaaaaaattctcctatttctcttcttccaaattgtccagcatacaattgtgaataaattgtcccaaacacggtcccagttagcaaggcaatgaaagtcactgaccttctctatgtctttcctttaagaagcctttttcaattgatcaattctcttgaggatccacttcagcaatttaaatgcagacatgtagcttgtcaaagatgaaagtacagagttgataagagccaatctatcttctcaagatagaaaattttctttccaaaaggccaatcttgtcatccaacattgttttgggagcttcttctcatatagcggtagtcttagataggtgattgggggaggacacttcttttgcaattcatcaatccaacaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaattatgacattctgtggccatattatgacatcctacgatcaaattataactttctacacaggatattataatttttcttctagaagtcataaaaaaatgatatttttatccttaaaaacttataaaatttttaaatgacgaaaatatccatcccttctttataatatcctatggttattatgactttttacacaggaattcataatttgaccgcatgatatgataacatggctatagaatgtcataattttaacacaaaaaaaaagagatatttttatatttcaaaattttaaaagaaaaattaaactatagataaatgtacattgaaaagtgatggctatgtagcccaatcagatgggacgggatggtatatattttttatactaattgcggtgtacaaagaatttcccatctctattttctcaggaaacctcgaccccattttgtggattataacaattgttgattataaaattaattcttgtctttgcggatctctattttctcaggaaacctcgaccccattttgtcgattataacaattgttgattataaaattgattattgtctttgcggaaatgtcacgttgagtaagcgacagcgccttgccgtccagtttccgactactccaagtgcacacaatataatatgatgaattgatcctcccaagttggcatgacgatgaatcctttgtaattctagttgcaggaaattcttccaatcataagttataccaaatatgatggtaacgtatgcacaaactagaggcttaggttctcttgggggggttgaagaaaagagaaaagcttgtgactcacgacaaattcctgaacctttttttttggtagaacctgcagccaaaggctactcattcaaggattaaagttcagtatcagagtttacaggcctgagtacaatggttaagaagattacaccttacatcagacagcatacactacatgacttagggaacccaaccagcttaagaaaatgtactcaaacaaaatcgtgctatcagcataacccagctacatattcatccccagtaacttttgaacctggatttcagagagcaccattcaggatgcccaagtccagctatagttggcaggcacatcccacagatcggttgaatccgtagagcttcgcatatccactgttgttgtcgtttccaagctttgccactacggtctttctgcaaatttatagccagttcatgtggaataacatcattggcgccccaaaagcattctgtttgcttagccaatttggcatggagatgggcagctctatttgcttccctaagtacatgagagattaagaatatgtgacagtacttaagcttccaatacaatacatctattaacagtggcagactctgcgtatctcccaccttacaaatttctcactttgcgcattctctgccatcaatcttcttctggtcatgtccttctcctagtgcaagaagttacttaacaagcccttctgtaacagcttattctagcgatagaacctatttgatgtcaaaagagagaagagctaattcaatagcagcggagggatgcagattcagtggatcttccttgctctgattctattcttgataacctgaaaccaggaaagagccaacggggtgaaagaggtatataaaaatttggtgggagagacctctatgttcatcagcttaaatcattcaatgattgtttacaattctgtcatctatttgacatgagggctacaggacttggtcttggagttagcaatatcaaaaataacagataagagtctccttcaggcaaatataggcagcttttagttcaagtactgctacccaccgacccatccaggcagctacaagttcagcgtattgaataggacaatgatatatagatttctcactaactttagtcagatatccattagagttttgaattataaagcccaggatcactttgtcatttcttactgctgcatcaaaattgactttaagatatccagaagagggaagtgaccaagaaacagataaggatgaagaattgtccaattcaggtggagacaaaatcaccccagcgcctcgatggattcttagagccaagttgatcaccttcattgtcattaggcacaaagtaactagggattctatacagcaattgactaggggaaaaaattgcattctgaaaaattctgtcattgtggttctcccaacaacttctagaacccctgcctctcttgtataaaactcttccatcaataaaatagtggtggctgttttttcagcctcctttacagtcaaaaaaaaaaactgtcattgcggctattcgataacagccaagctgtgattgccatgactgatttccatctcccatcaacctcaatggcagaaaaaaattccaccaagccaggcagtgagaatggaatgatgtctattttaaaatagcttctaatgaggttccaacaatgtcctacaaatggacaatcaatcaaaacatgctgtatatgttcctctagacctgggcaaagatcacaacccattatgtcattgctagtgatacccctcatagctagaagactcctacaagggatgcattgccacatgactttccaccagaaaaatctgattcacaaaggtatctttgatgttcaaacccaacatgtattttggttcctgagggactgtctcccaaatgagagggtatatatctttaagtttaaaaccttgcccccatattaactgattagaacagttaatttgcccaaacggcactctactaatttgtttcatcatatcagctgacattagctgtcccaaaagataactattccattccagattagaagagagaagatcacacacttttgatgtctgatacttgggagtcaacattaacgtaagttggccatctagcaatagaaatcctatcaatccaaggatgattaactacacttacatcctttccattcccaattagccacataaagttgtattgtattaagaggccacaatcaaaaattttcccccagatggatgaacatttctttgatttagaatactcggcccatgaccctgaaattttatagttagctttgacaactctggaccacagggaattaggctgtagaataacttgatctgcaagcttgcacaaaagggctttttgcctgatgttccgaggtataatacccgaccctccccgttaaaccagccggcaaacattctcccatgcaagaaggtgtaagcctctttgatctgaaatatacccccaaaagaaggctctgtattgcttctccagtctatttaggatataaatagggacatgaatgcaagacagatagtatagaggaatagatgatagcactgatctaattaaggttgctctgccagccatagacaatgccttccataatattgccatcattttctcctcaacaaaagtaaaagcttctctattcaatagcctacctaaaagagaaacacccaaatatttccataatcttgtgtgttcattaacttcaaacatccttctaatttgagctttagttcttgttggagtagctggactaataagtggatgggatttattgagattaggagcttgcctagataaggaacgataggcatcaatgattgctttcaggcagcgcacatccttagcagtagctttagccaccaatagacaatcatctgcaaagaagatatgagatgctattagccctcctctagctggtttgtaaagccctctacagactaattttccacggcataatgaataaatcatgacaggacttcagagcataaaataaacgagggaaaagaggacaaccttgtcggagtcccctatagatggttgaaaccattgcattggggaaccattcaacaataacgcaaaggtagaatccactgtacacgcccgtatccaagctacaaacctaaaatgaattctgaattgcttaagcacttgaaataagaacggtcaatgcacatggtcgtatgctttttccatatccatcttgatagccacatgtacttctcataggagatgctttatctaacaaatgcatcatctcttgagctaataatatattctcagttatacttttcccttttatgaaagccccctattcatccgcaaccaacgaagcctgtagaggctgcatccttttggctaaaattttagccacaattttataagttgtattacaagagcttataggcctgtaggcagccggttgttgggacagtctttcttaggaataagagttataaatgtcctattccaatcttttggcattgtcgaacgattgaagaaatattgtacagcttgaataactttcttcttgattctataccaaaatacttgaaagaaaaaagtgggtaaccatctcggctcggagctttgtctgggtgcatactcttaatagttttcttctattttctcttctgaaactggtctaattaatgtattgttttgagcatcagaaacctcatggccaattaccagaatattcatttcttctatatgctgctgtctggtccatcttattgaaaatgttccacaagcattctgcccacctcttctgttttgtattagactttcttgttcatcttgcatcatcaaaattctattcctctttctcatactggtagttgatctatgaaaatatctagtattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttcccttcaagaggtgccttttgggccgaaggcccagagggatcctatatcagataatgaatcagagacaccttgccttataaggtttggaggctctcctctctctcaagaggcaccttttgggccgaaggcccagaggggtcctatattagataatgagtcagggatacctcgctttataagatttggaggctctcctccccctcaagaggtgccttttgggccgaaggcccagaggggtaaagctgtgaggcccggctatcgaaggtgaatccgtccggttaaaatatcagtgccagagcggacaatatcttttattcgggagagagccgaatccgacctcatgaggccggggttaccccgatcacaacatctagcattctcatccccttgctttaaccacgcggctcttaatatttgtttccatagaagttcttgcagttgaagggttttgttatacttactcaacaatgacaggagctggttatgagcttgatcattgagacctccatattgagcctcccgcattcgaaggatacagatcttttcatttaactgctgagtattagtaaaaatattcccaatccgttgcttccatctgaagatagctttcctgattttgcttaataatgctgatcatttaacacgtgatgaataatttccatggcaatgccatgcttgcggcacgtcttcatgaatcccctcacggtgctgtatcttctcaaatctaaagggggtttagatctttcaactccattacttcaagaaagtaagattggacaatggtttgaagcaaaccttgtcagatgctgcacgatactctggaaacatggacaagcgctactcgatcacaaaagccctatccaatcatacccaaagtctagctaggcccaacctgttgttacatcaagtgattcaggtccttagaagtccagatcaatgaaccctgttcgcctaataaaaactctaaactccctaatctccctattcacatggaatagctgaccccttttcttatctgtattttgcaaaatacaattgaagtctccaatcaacaccatagggagttctagtgacaatataacctcagtttctatccataattttctatactctagttcagatgtgctagcatacacaacacctaatttctatcgttgcttgtggtccactgaaataaccccatgtgcaacttgtctgtcattatgaatgaaatttatataatttcctacagtttttctccaggcaacaacaattcatcccgactgaccctgtgtcggaatcatataagaatcccactagggccccagcaacctcctgatccaaggccaaaccaatttatctagtcttgtctttggaaaacaacgcgtatctagattaaattgtctaatcaaagttgtaatgtagtttgcaaaagaaggcttggaagcccctctacaatttcatgataatatttttattaaaaattaaacataaatgcagctgattctccattcaaattttagatttaaagattattgagaaaaaatttctcacttaaattgaagatatggattaacagaaaagcagatgatatgatatgcaatatcgatgtcacagcacaatcatgaatgaaaatgtgtgattctaaaataatatgtttcttctgtactgtatgagaattatctgaaatcatccaatacataatccgagacctcctggccctagcttcggcctctgacgatccttgacttctaatgatcatcctaagcaaaatactcaggatcagtcgatcctgacttcggccgcatcttgacttcggcctcaagcctgactcagttttcatgacggccgacatccgacaactatccaatatttgtagatgatcggatagctgaattagccgattttttatttcagctataggtatactttaatcttcactacttttatcttactgaacgtagttagttctagccgcttcttcccttcggcatctacttccatcggaccatgctgaagcctccacaaatgaaactagtccaatcctaccaacacctctatttcaaaattcaaaagtgcttgcgacattagctggtttcggaatagataaggtaggtgtaactatccaatcttataaatttcaatcaaaaatctcaccatatcgcatctaaatcggccacataacctacccaaaatggtctttcaacctttgtctataaaaagacctctaggagacatccaagatacatccgaacaatctctctacactctttctcacctattctcttgatttctgacttgaacattggaggattctcatcggagcaaactctggctaagacttgccttgcaggattctctaccaaaggatgcgccaccgctctagctttttcgatcgagttccaaattttaatggcaacagattgccatccggagacttcggccttacttctaggcacatcctatcatggtgctgacaaatcaagcactcaagatagtcctgcatcgacttgatacttctggatgattggcaaactggccaatccagcttgctgagttcggggtgaaatttcagccctagtcttctatcaaagcctaaattttggcaaacttcaccgttgaatgcaccatttcgaacgattaagagacaccagaactgacttaggaaggaggtgcattggtggaacccagttcatcaggaggatcggatgacttttgggtggtgcatgtggatgattcatcaaactccatggggtcaggagtgggcctactgcttctcagaccagaagaggctatcgtggaatatgccttggggcttgacttctcggcaaccaacaatgaagccgaatatgaagctcttattgtcagactcaaaattatgagggaactcagggtgaagaagctgaggatctgcactaattcacaactagtggtcgaataagtaaagggagacttcaaagttcgagagaaaaatataaagaagtatctctaaaatgcgaaagatctggcttcgacattcaacaggtaccccgattcgaaaattaattcaagagctgatctactgtccaagctagtaacatcgacctcaaaagatttaccttagaagatactttttgagatcctaaagaagccaagtgttgaagaactgatcccgatccaatagattgaggataagccttattggatggatcccttcatccattttctgcaagatgaagtattgcctgcagactctaaggaggcccaaaagatcaaatatcaagctctccgctatgtcttctatgaagataaccttacaaacgatccttctccctaccacttctcaggtgccttcatccctctgaagctaagtacgccctttgagaagtacataaaggagtatgtggggtcatttagatggcaaatcattggcctacaagattcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagatcccgatgtaggatctggtgtggtgctctcaaggctcaggggatcaaggaaaaggtcaagttttaaagcccatgaggcattcatggaagttctagggctagtttgggccctagggtgaaaggctgtctgccttcacagttttgaagtctagaagatttgagccttgagggtctaatttgtattgaactaggtttgagtctaagagaggtgagattgggtcaagtcatgggtgtatatgggcttgagtaagctcaatctcatattgagttaaccatggaagttttttgggttggatcacattgatcttatatataaagatatattgtaattcggtttgactaagcaaatcaatacaagctcttttctccatgaactttctctctcctcatctctctctctggtgtggagaaatcctagccaccatctagggttgaagaaggaagcccaagcctagccgccccatcatacttctcctagttcgagtaggagaaggtccttgccgcccataatatgattttctggttgttctaggactttgggatgcccaaactgccagaataattgctactcctaatctccttgcttctctagaagttgagataggcatccctaagtaatcttaaaaggattggaaagcagatcaaagggatctataagaaggctactgtccagaattctctacagcaactccctcgtgtttcaacacctccacagcatccaaaagggatctccatgcttcttttctctactggttagaggctttatttagggagcttccatatctgaaaaggagggttttagatctgaaagagataggatttgaaagagacaagaaattctatcaacaatcttctacaagttgctgaaatactaaaggctgattttgatttagagatttattggccatcaaagacctccaacggccccttgttgctggttccaagatcaccacttgagaggaaaaattttcaacatctggtattagagctttggagttctattgggtggaggaaagatcaaagtttcgtttggatcttggtaaggtgctgaacagattttgtattgaacaactttcttgtttgttggtgtttatttgttgagatccatatgggatggcatctagtagcattaaggtggactttgaaaaatttgatggcaaagaaaacttcaacctttggcagcaaagaatgaaggatctgttagtttagaataggatctataaggtcttggttcagaaagatcgaaaaagatcaatatagaagactgggaggagttagttgggatagcttttagcaccattaggatgtacttagctaatcagattctacctaaggtttgtactgaagccatgatgaagggactctaggagaggttagagaatacttatataggcaaaaatatgacaaataagttgtggttgaagaagcagttgtacagcttgaggatgcccaaaggaggagacttgattgctcatatccagaagttcaacaagtttggtcagatgttatgagccttgatgtgaggatagatgaggaggataagactctcctactattgtgttcacttccagtttcatatgatggtctcattacaaccctggtgtatgggaaagagaccttaaactttgaggaggtggttggagttctcaggtcaaatgagcagcagaaaaagctatgtaaagagagttcgaatttagaggtctttactgtaaataagaggcaaggtaggcctaaggagagggctcgagataagtcaaaaggcaaatcaaagttttgaaacaatcagaaggcctgaaagtactacaagtatcatcagcctgatcatctgaagagaaattacccacttctgaagaatgagaagggaaagggctcttccaagggtatttcgatcaataggagtggtgcacactcatctgagaatagtggagatgatttactggttgtatcaaatagaaccactgagtatgatagccattggacactagatttatcatgtttccaccactacactgcatatcaggagtggtttgcttcttatgagaaatctgattgaggaagtgtgagccttggagatgatcatccatgtagggttgctagtgttagtattattaggatgaggatgtatgatagagttataaggacactcaccaatgtcaagcatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggagagtatttacatggagcaaccatcagggttcaaagagcctgggttagaggaggaggtctgtttgctgaagaaattgttgtacaagttgaaacaatcgccaagatagtggtgtaagcgatttgacacttttgtgaggagcattgaacttttcatgtgtgaatatgatccatgtgtgcatgttaagtctctgaaagatgggtccggggtatacttactcttgtatatgaatgatatgctgatagcatgcaagagtaagagggttgtgtaagaattaaagacagccttatctcaggagtttgagataaaggacttgaggcctgcaaaaaagatcctaagcatggggatcaatagagatagagccaaggggctgctgtatttgtctcagagagattacatacgaaagatcttagagagatttgggatgaaggaagccaaactgacagcactgttaattgccaggcacattagccttttgaagactatgtcgtcacagactgaggtggaggtttagaagataaagagagtgccatatacctctaatacgaggagcataatgtacaccatgatatgttataggctagatttagcctacgcagtgagtcaggttagtaggttcatggaacagcctgatggggagtactgacaagcactgaaggaaattttcagatacttggaggattcagttggagtcagcatctactacgaatagcaaggaagcactgagggacactctaacatatccaaggaggttcaggggtagatagaatggtttgtggatgcggattttagtagagacgtggacatccgatattcgacgacaggatttatattcagtttgaacagaggtcccatttcatggagatcttgcttgtagcccataacgactttatccaccattgaggtagagtatattggcatcacaaagatagtgaaggaggctctgtggctaagggacttagtgttggagatgggcttctcatagaaaatcttcaagatgtactatgacaaccagagtgcactattatttgcatagaactccatctattatgtgaggatgaagaacatcaacattagataccatcgaatcagagagattatggaagaaggtgaggtggaactgatgaaggttcacactaaaaaaaatctagctgatgcattgatgaaggtacttccgtgggacatctttcacaaatgtgtgtcactgatgggattgatgtacaggataaaatttgttgaggccttgggacaccaagatagagattgtagaatttgatatggtgctcccaaagctcaggagatcaaggaaaaggccaacgttcaaagcccatgaggcgttcatggtggttcttgggctagtttggatcctagggtgaaaggctgttaacctttacagtttcaaggtccaggagatttagactttgaggggctaacttatattgggctaggtttgagtccaagagaggtgagattgggtcaagtcatgggtgtacatgggcttggatgagcataatctcacactaagtttgccatgggagttttatgggttgggtcatgttgatcctgtatataaagatacattgtaattcggtttgactaagaaaatcgatacaagctcttttctccctaaactttctctcttctcatctctctatctctaattgctgaccttttaagtatggaaaaatcctagccaccatctagggttgaaggaggaagcccaagcctagccaccccatcatacttctcctagtttgagtaggagaaggtccttgctgcccataacttgattccctggttgttttaggactttgggatgtccaaaccaccagaataattgttactcctgatctctttgcttctctaaaagttgagatagacattcctaagcaatattaaaaggattgagaagaagatcaaagggatctataagaaggctgctgcccagaattttctgcagcaactcccttatgtttcaatacctctatagcatccaagagggatctccacacccctttcctttgctggttagaggtttcatcaaggaagcttccagatctgaaaagaagagttttagatctgaaagagaaaaggtttaaaagagagaagaaatcctgtcaacaatcttctacaagttgctgaaatcttgaaggctgattttgatttagagatttgctggctatcaaagacctccacgactccttgttgttggttccaagatcaccacctgagagaaaaagttttcaatatttggatgattgagaagcgaagattaacctagaaggactttcggagggctaacctacaatgaccctcaacccaccaacttcgacaataagcgaagactaatctaaaaggtccttcggagggctaacctataaggatcctcaacctaccaactttggcaacaagcgaatgctaacctaaaaggaccttcggagggttaacctacaaggatcctcaataacttcgataatatatgaggctaaactcaaaaagatggtcgctttacgggcatctctatgagatctctcaacgcaaggatcatatgcggattaaattcgaactatagcacaatcaacaaggcacagtgaacataggtaaaataaaaatttcaaatctcatttttattaatgaacttttgataaaagttgcaaaacggacgtctataaaaaagagaggaacaaaaaaatacatctatcattgactatcatttgaaggatccacattcgatcgatgaaacctcaatgttcccaccatctttatagatctcaagatgagagttgacttcataaaaaagttgcctggccaaactttggcattcctcgaagccaatgtcaattgattgggctaatatatcggcgaccacaatagttgcatcacacaaagtcgaagcaagctgatcttctaatagcctaacagtggccttagcgtgtttagccgtcattgtatttttcgtaaattggattcggagttcaataactgtagatctatctttgtttagagctcctgatagatcagtaattatttttctagccaagataagctcgctctggatattatcgactgctgacctcatcatgtccattgcctgatgaagtttcctaatcgtacctttgattgagtgaagatcatcttgaagtcggctaatctgcttcttagcttcatcaccaactttgtccgatgtaataatatgcttcaacttgaatatttcatcttgggccctatatacttgctcgttgcaaagaacttttgccacccctatcctccagttagcatccccagcagacttcgcaaatttatcacgctctttaattaatctatattttgcggcaaaatattttctatctgtctatttcagatacctcctcaaatgctctacttctgtcgaagactcatcactattcttcttcaccttttagagcttcttttttgcttcgacagcatcctgttaagcctgatagaggttctcctgaagattcttaacttgaacccttaaaggcaaagatgttggcatatgcttgacacgatattgtacaatcgtataattgtaacaatcacatcgaacctactgagaaaagcatcacaaatagatatgaaccaaagaatatgagcaaaagttactttttcattaactttaaaattttccattacattgacaagaaaagaaaaagaaaaagatatacgagtttaaatatttccgatcctggcatgaggatcggtggaggagctagagataactacagctggttgcttcgactccacttgtggtggcgaaattggtgcaacttcggcagaaacggatgcaggcaccacctttgggggtggagcagcttcagagctctttttgacagtcttggccactgaagctccatcttctgcaacttcttcctcggttcctccttctttttcttcctcttctatgttatccagaagctcaaatctacgttcgaaaagtgcacagctaccctccgatagcagatgtccaagtcggtgttgaaggcctcctggctaaagtcacatttctctttcaaaaactcattgaatgcatggaaggcttccacagccatgcatttggctttggcaacctgatccttggtcttcttctcaacatcaacagttttggcttccacagccgtgcgcctgactttagcaacctgatcttcaaccttctctcaacattgacaattttggcttgcatctctagcttcctttccttctctaaggccaaattggcttcgactttctttagcaccatcttcagatgagtggcctccacccttgacttgacttcgacttcagaagtttcgatcatattgtactttttatgcgcttcgatcaatttttccttagcatcacatatcttatttatgaggacagcagcatagtgacctgcttgtacccatagagcaagaggtcaaaaaaatgaaaagggagaagaaggaaaaagaaaagggagggagaaataaggatgaatttatccatactatggaggaaaccatcagcttttcccttcaaccttttttaggctgacatcaaaaagcatcctccgaaagatactatgggtagtcttccaacattgaagatgtcttaagaggatgatgatcctgaaccctatctttggtccattgatcccctgctgagtctaatcccacctgggttaaattgatctggagggcagggagcgtaactagcttcgagggtcgagtttgaaagggagaaaccaaaatagctccctcctaagataaagtcggggggaccactttcttgttactctcatctgaagtcttggacttttcctaaccatcagtggatgaagagggtgctttcctcttcaacgaacctctcatcagtctcttcactttttcaggctttatttcttaataaaggagtcagcatctataaaaatgagaagaacgagcatcaaaaaaattgaagaaatcctcacctttggggttgatcgaactgatgccagcattgaattgtgcttactccgataacaactcctttaatgaaaaaatttcgtatttccttaaggttgtagagcactgtaattctccatcttcaagcctcaaaatttgaaaaacaaaatccctcggtcgatcttagtgtagaatctccactactttataaaaggatctgaaataaaaaagaaccaatccttccagccatgcattgaagaaggagcttctcttatcaaagtggagaccccctcggaggagagatgtactatcaatcatcggtacatctctttatggtgtagaaagatcgaaaaagagaaagagaaggctagactccagctttagaacagagaacaagaaaggcgataatgaaatgaaagaagttagggatgacagaacaaaggaaaagataaaaaaagtagaagagctcaacaacaaagagatggataggaagcctaagtccgactttgaaagccttttcatatagatcgttcttactaggtggactattgactctaccactcagcctaaaagattctaattcgaaggcggttgggatcctgtactggacatggatacgactcaagtcttctatgcccaatctagatccaattatgtcagaaacgaagggaggtgcaacactacgcccttctcccacatcgacaggagttttccacgaagaggaagatgatttgaaaatcaattctcgctaagactcccagaagttgccattagaagcacaaaaaaaaagaaggtgatcggactaaagaaactaaaaaaaaagaggagaaaggagaccaactttcagcaacatgacacagaagatgagggtgatgattctgcaaaaaataagggtggcaatccaaagaggagctgttggggatcgagaaagctcttggaacaggaaagagaactagaggtaaaaaagaaataggcccggaagagtccaaaaatgcgaaagaagaaggcagaaaatacaacttccttatataggtgcagaagatcaaagccatccgaatatcaattcctgtccaaccgtctgatgactgacttttggcatgattctattggcatgcgagatgtcaatcagctcattaatgatttgtgtgggaaataaggcatatcactttttgaattccaccaaccgcctttcgatcatgattactcactgatatgaccatttgttccacccaagaaccacaagcatcatttcgataggaaggacggtatgtctttgataaatctgaactcatgtactcccttcatccatactgaactcttgagtaaggggcatgtgttggaagaaaatttatcatttactcacttaggccgaagacatggactaacagaagagcagatgatatgatatacacggttgatgtcacagcgcagtcaaaaataaaaatgtgtgatctcgaaagaatatattttttctgtaccatataaaaattatttgaagtcaaccaatgcataacccgagacctcttgatcctagcttcggcccttgacgatccatggcttccttgacttctagtaatcgtcctaagcaaaacactcaggaccagtcgatcctgacttcggtcgcatcctaacttcggcctcaagtctattttagtctccatgacggtcgacatccgacatctgtagatgatcggatagctgagttggttgatctcttacttcaatcataggtatagttctgccttcatcactttttgttgaaaaatatatcctaaaatcaattatctattcgtagtcgattgtgctctttgtaatttgtatatgtattattaataaataaaaattatttttgataagttcatcataaatgtgtatttttctttgaactcttgtattatgatgaagtctttagaactataatataattgataaaggaggatttatcaaatagttcttaaacttatttatgatcaaatataattattaacaagaataataatatttatcgagtataggtcattgtgcctcatatggattggttatcctcttaaccaaagagtgtagagatactgatatggcatacagatataatgtaggagtatattattaccgaacagtgactcacctatggggcattctgctattaaggatagcttgtgaagcatatggatataagtatcccatcaatctaagatcactatggtgacttgtaagcaactcactatgctttgatgtcagattatctgtatttttaatatagtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctatctagacgtcagatattattgctaaatgatcacttcaaatagtatagaaaatagtttctatactatcgatttagtgtttgaacctatggagtcacacataaagtcaagcaatgtaagaaagaattgacctagtatctattttgaagtatgagacttgattgaataaatagatttacttaattgagaattaagttatagatcatataaaattaaacactgactatatctagctagcactggacatgaggtgcagatttaatttcggagatgaatttgacctaatctatgatccaaaggattttgagagattggattcaagtcttagttattttagattagatctgatttaattaaggctaattgggttagttatttaagttgaatttggatttgaatcttaattagattaggattaacaatcttttagaatttgattcgaattagattcgaattgaatgcaaatctgaatcaaattggatttggtatactaagctatgcttccttgggactctctctcttttgggctgaccaaggaagtggtggggcactagttttcatgctccaaccccttgtgcgtgcgtgataagatggggggagcaaggtggcacctctccttctgcctttgggactcctcatagattagaaaaatttggatttgattcaaatttgtagagtcctaatccatgaagagtatgattagggtttgggcatccaaatctatttaagaaggggcatggaaaggggtagaggtagattattcttgggtgtgagcacctcctaggcgcaagacctcctaagcatgtgcacctcttggcgtgatcccctcttggtgtagagttttttctttcagacgtgatcaagccttctctagcctccctcacattgagaacagatctcaaggctctcccttgcttcccttctgaaggagtgatgcttgagtcttcatccctcactcctacgatgcctgacatgcatacgaagtagaggatctacgtgtctagatctcgcgaagtaacgatcttcaggaatcaatcaatcttaatcatttttttactatgcatcaagataattttcataagagttatgaaaaattttaaatttaaaatctattctctttcttcatggcattcgatctgatcggatattttttcttcaactggtatcaagactaggttgaagatatgagtgcataaaaatatttttttgttattttttgatctggtatgtaaccaaatttttttagataagatctaatcaggtttcaacctaattataagatttttttctgatttagttttgatcagatttttggattaaattagcccctgaacctgacctattaaaaatctattttaatagaatttttttcatagatttttctgtttaacttaggatctgattataacctgatttaaatatattttgaatagatttttgtggatgatttttagtcatgaaatttatatttaatcaggttcatatctgaatctattttgatagattttcagatctgattttggacagatctctacagttgttttgatttccatctaactagaatttttctatgcattcatatcaattttttgaatagatttctatgctattttagatctaaattagatggtttatatgctgtacaaattttaggttcaaatctgaaataattgtgatgttatgtaatgatctaattagattagataaaaattctacatgctgttatgttatgaatatgatttgaatcatttttttttcttttacatatatgatatatagtgtaaaattattcttagtagccaagtattcagattgagttgatcaccatagttgtccgatcataagaggaagcaaggattaaaatccttctcttatccaatcgatgggctctcttatagcatgtagaggtgccgctgtgattagatctcttgaagaagaacagcgaaaatttttttttaaaattattttaattataaatatatttaaattagatctaaaagatttatgattaattttgttagatttatgcaaaatattcagatattaaaataagttttattatctaaaaaattagtgacatatgatgtaagttttgtataattttttttttataaaatagttttacaaattaaaatagtttcaatatagaattttatatacttaattgagaattaagatataaaaattaaaagatttagatttgagaattgaagatcttaagatacctcataaatcaaggagctataggatagcttgaatcaggttatttaaatgggttagacctagggttagaatcgaatttggactaaattgagaaatagattaaatctaatcaagttttgaattagattaggtcaagatttctttagatcaagctcaatagttgtagctggatcaaagtctattttctgattttatcaaatggatctgatcgtggctcagtggttagggcttggatcaataggctgatctgatcaatttttgttgaccaattagtatctaaggtaagtttgacaattcgactgatgatttttaattgacaacctatttatctagccattttgatggtgtctaagacaagccttgacagaccctcccaccgatctcacttatctgactaacttgatcaattaagttttaaattaggttgcctgatgatttaagctaacccatggcattaaggttaatcagtatggttaatttacatatctttggaccagcttgttcttaatcctctttgatggcttggtgaagtcagtgggagaatttttgaattgctggttaatttcttttcttgactctaaaatatataattaatttttttaaattattagatccttaaaatgataatattaaagggttagcaagttgataaccttccattaagatggatggtaatgagtccaatagtcttgttaagcattggaagtgccacactcatggtgtttatctgactattgaaattatcattcattatatgatgacgcagatatgactttctagtgggtggttaggttggtcgagccacactcgagtctaatcattcatttgttagatacactgagtatgatcatattaatagttggatctaatcaggactttcagtggagacgccacacgcttgctgaagagaagcttggggcaaaattattacaaaaagttatttggagaagcaattggttgagaatccacccataaatgcatatggattggtcgagccacactcgaacctgtgtatagtttatgtggattctagtacctgctaagaaattaacctaatttctcaaattaaaggtagagactaccaatttgtataaaatagtgagagaacctttatactagagtccagatctttaggattaaataattcatatactaatagactttatgttttctttcatgtagtaatggctaatactttattgctccacttgctgctggatagcgacaagctcaccggatccaacttcaatagctggtatcgcaagttgaagatcattctggagcataagaggatcctatatgtgattatagatcttctacctgaggagcctgccccaaatgctcgtggtgtgatagagacacttatcagaagtggctcaatgaccgaaccactatgtattgtattatgcaggtggctatgtatgatgagttcagtcgtaaatttgaggctgcttagccagaggagatgcttcaaaagttgaacgaatcctttggaacccttgaggatgaagagaggcataaaactttttatgcaatcttcaatgctcagatgagggaagggacatcgatcatgattatgtactgtacataatcgagcagatcgagtgcctgagcaaactcaaattttttttgcatgagcagttaggaaaagatgcaatcatgaattctttgcacaagtcctacctaccctttcttagtcattatagaatgactaagcccgcactaaactaccagtttgctagaattactacagacctttgaaaaggatcaccagctttacaaagagccagtgaatatggtggtctctcttctggacgtcatctctttaaaaaaggaaagaagaagaataagaagaaggtgcaacgtgctgggctgtttaagtctaatcagacccagaatctcaaagcagactagagttaggcagagtacttcttacgtaagaagctggatcattaaaagagaaattatcctcagtatcttgcctcccttgacccaaacaggcttaagaagagaaagtagcaaggagttgctggtcagcataattatatgataacaccttataatttttctatctgtgatactactatctagatattggatattaaaaatttaattaatatttataatttattgcaagaactttaggttagtaaaaaatttgaagccgacgaaaggttcttgaatgttggagatggaagtcatgttctagttctagcattaggaattgtccatcttgtcttcgattctgaaattgttattttgaatgagtgtcattattatccttcgttccttatgaacattatttctgtaggccttttggccaaagatgattttaacttttaataaagaaaaattattgtgatatcattatgaatgatgttactgtaatacgtggataattgagaaataatatttatatattatcatgacctgtaactgtaatgtacacatctaatatatgtcctaagatagataatatcagtgatgcctacttttgacattgtcggctaggtcatgtgaacaagaacatgatagataggttaactaaaaagaaaatcttcgacattaacgattatgaatcattatcgatttgtaaatcctatcttcttggtaagatgacaaagtcatcttttaaaagaaaagctgagcgagccattgatgttctgagtttagtacatagtgatgtatatggacccatgaatacaagtaccaaagatggattcaactacttcattactttcactaataacctatcgaggtatggatacatctaccttatgaaacataagtttgaatcatttgaaatgttcaaacgattccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactatatatatatatatatatatatatatatatatcataaactatttcctatcagtccataactcataaaaaatcttttgaactattttagcaaaaatcttatttaagatatgcatagttatctttatagccttattccataagtaaataggtctaataaaataacttatcataatgcaaaccacttctttaagttattctttctttttgtcacactattttgatctagcgtgctttaacattatgtaatacaatgccatgttcttttagaaattttgcaaatggtcctgatatttgttccatttcaatatgttttcatattacttgtcacctttattgaatctgactactttaattattttttctgattgtctctctatctctatttctaattttttaaagttttcaaaaatatcagctttatcaaatttaaagtatagatacatatacaacgaatagtgatagtgtgacaaaatatttgtcacctcttagatatgaaaaaaaatatttgtgtataatagtgtgaatgatttctaaaatttttttaatcaacctaatattcttcttaaatgtgtatgtctgctttatcttgatgcaatcaatacatgttacaaaaatagtgaagtttaatgatcctaatattctatccttcattagctttataactctttctttggagatatgccctactccttgatgtcataatatagaagagtttttaaaataaaaatctactccacaatcgaagactattctatagcatccaactatcttaataaatgaatatgcttaattttcaatgagaatagaccattcactttcaattagtgccttcttaatagaaagtcctataaattgttggcaatgtgcataaatgcactagagtcagtgcactagatagaattaggaacatttactaaattagatttaaggcacactcaaaagtaaaaggtatttttttttgcaactatcttttatacttcatgcagttttctttaagtggcccatccttttgtagaaaaagtatttgacaatcttattaatggcttcatctaatatcacaacaaatacttattaggatctaggtaattctaagcatgctgaatttcaaatttttttcaaaacaaaggcagtggaagactagattaaactctttaatctaagcatacaatgatcatatcataacacttattttatgccataaaaataaatagatagatttgacatcagaaaataaaataagaggtaatcagattacttacttaattcatagaactccttctcgaatctggatctacggatacctttagcaagtttcattttagccgcacaagcgtctgatctctacggatatccatacgaggcctgacctgattggaggctttttgttctctctgagatgctagctcccttgcagagaatattttgttgatggttggattggatattcttcaatctataagactctcttaagaaagaagaagacaaggtggatgaagaagacaaaacaagagaacctttctcccttttctcttctaaaacctaatgcccacaagagccccacacccctctaggaaagctcatgccgctctctgatttttcacagtaaatgtcagattttaaaatcctctcacacaccccataaaatcccttttaatagacatccaagaatttggttgagattgggttttgactaggtcaaacctaatcaagaaaggtttcatgtttgaatctaattcaaactttaaacttatcccaatcttaagagaggaagggtgggtgtgggctccaattggcatggcttttctttcacgtaaaaccagaattcacatggagaatttgggcgttaaaccttaaggcgtggagatggagtgggcagccaagaacaagatgaatcccagatcaactgggaatttcttgatttttgatttaatccttaactaattttgggtccaatcttaactaacttaagaattaattataactaattaactaattaggtcttagtccaattaggaatccaattagatcctaatccaattagaaaattagttaggttaaaccccatcaaattagagattgatttcttggacaattggattatctcataatccaataggcttgatccgatcaaacccaaatcaaatccaatcgaattcatttttgaatagatttaattccaaccccattgctcaatcaaattgagccctattataatctaattacaaattaaatcctccataatatctaatctactagtggcggctagcagcatgtggtgatagtccagcaaaatagaaagtagaacctcttggtgtagttaccatataatttagtttttttatcgtgagtctcgataagatggaggtcatgaaaactcatcaaactccatcatatgttatataaaaaattcgatcagctcgagtcaaaattatgaaacttatggaaacttctttccattaatcaccttgcagtagccactgacttaaggactcagcttctcaaatttcataggactgctctgtatctactaaggttgatagatctcctataagtacataccttactcctacagcgaatctactgtagccaacgaacatcataagacctcgaatgactaaggaccatgtttatgtattgtcaaactacagcaatctcaccatgagtagtcgaggcaccataagtcaaagaaccactcgtactactacagcatcgagaaggtcatggacgagtgagtagacatccatgtgatctttcgtacaatcatgctcagtaacaatgttctctaacatccacctgcactctcgtccaatatccttatattgtaaactagagactcgtctatccaaaggaggtgatccatacattaatctattcaaatcgatcaccatctccgtgatgatccatcgatcaggagtaatttaagaattaattatacacgtttctaaatctcaacacttgaaaattttatatctttcaattattaatttcttagatgatttaagcacacattacgcaagaataaaaataataactacccattttattaataaataataagttaatgacaaatttatgtcctgaaagaatgcaatgtgttagccaacttgacttttcagatcatacatctaacaatctctcacttgatctaaagtcaattgattgtatacctaagacccatcttctcaaggtgtgcttcagtcttctgttggctgagaggctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagtcatatgattgatttgattagcttaagttcaattattattctcataaaaaaaattttctatcaatcacaatactacagacacggactcacgaacttagcctctcaaatttcatgaaactactcttttctatcaagatcgatagattctatctagatgcgcatcttactcctatagtagaccaactgtcgccaatatccattacaaagattcaaagagaccatatttctgtgttagttaaactccagcagtctcaatgtaagtaaccatgccatcgcagaccaaaggatcatttacacaaccacagcatcgagacgatcactgacgattgactagaaatttatgtgatctctcttgtggtcacgctcagtactagttattctctaataactactcatacttgtcgctcagtgtctctacactatagactagagactcatctatcccgaaagaagtgatctgtacattggtctattcaaatcgatcattatcctcatgatgatactatgatcaggagcaatttagaaattaattatacatacctctaattctcaacaccttgagaaaatatatcgtaagtattaattttatggacgattcaaggacacatcacacttaaataaaaataaacttattcttttgttgatcaaatcaatattttaagtataaaattatgccctagtgttattacaatatgtcagccatattgacttttagaacatatatccaacaatctttcacttggattaaaatcaattggccactaatctaagttctatcttctcaagatagactttcatctttagctggctctattgctttatcagtggatctattatattgtctacagagtcgactcttcatacctcaacatatttttttttgaggtagtcacatatgatgtggaatcactgctcgatgtacttgaattttttatgagatcttggctctttagcaagtactatggctccattattgtcataatacagtggtatgatatttgatgtcattacctcaagctccacaataaattttttaaaccagaagccttcctttgttacatctgaagcaacaacatatttagcttctatggtcaaatccgcaatgatggattgcttggaactctttcagctgactgcatcaccattgtatacgaatacataccctgacgtagactttctatcatcaggatcagatataaagtttgaatcaaaatatccctcgatccgtaagtcaaacccttctccaaagctcaagaataaaatcttagttcctctcaagtacttaaggatgttctttacagctatccagtgcttctcgtctagattcgattgatacttgctcgtgacactcacagcaaagacaatatcaggtcgtgtacatagcctgacatacataaagcttcctacgatcgaggcataaggaatcttactcatgcgctgagcttcctcagatgtggtcggacatattgtcttggaaagacgaataccatgcttaaggggtagaaatctccttttagagttttttatgctgaacctcttcagcactttctctatgtacaacttttatgatagacctagcatcctcttagatctatccctatagaccttaatttcaaaaatataggatgcttctcctaaatctttcatggagaatttcttgaacaaccatcttttgactgaaatcagcataaaaatatcattttcaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctcgattcacaatcttaggtcgggggtgtgacatcaactgtcatcaatatccactacaaggactcaaagagatcatatttctgtatcagtcaaactccagcagtctcactatgagaaatcatatcattgcagatcaaaggattattcacacaactatagcattgaaacgatcattgatgattgagtaaaaatctatgtgatctctcatgtggtcatgctcagtactaattattctctaacaactactcgcacttgtcgctcagtagctctacactgtagaccagagacttatctattctgaaggaagtgatctgtatatcaatctatcaagatcgattatcattctcatgatgatactatgattgagagtaatttaagaattaattatacctacttctaattttcaataccttgagaatatatatcgtaagtattaatttcttggatgacttaaggacacatcactcttgaataaaagtaatttatctttttattgatcaaattaatattttaaatataaaattatatcctagtgttattacaatatgtcagctatattagcttctaggtcatacatccaacagatctttgcagcttgcagattttgtgatcttcatcactgaaagtgaaccccaaaagctgctctgtatagatatcttcctcaaaatattcatttagaaatattatttttacatccatctaccatatctcatactcatagtaagctgtaacagcaagcagtgtacagatggacttaagcatggccacaagcgaaaagatatcctgatagttaatgccttcgcactgactataatctttcattacgaacctagctttttaggtctctacctttccatctacaccaatcttccttttgtagatctatttacacctaataggtactatactctcaggtagatccattaagatctagacttgatttgagtgcatcgattcaatttctgacttcatagtacttaaccacttctcaaaattgatatcagacatcgcctcgctatagattttggggtcatcttcatgatccctatctcctacaagaaaaattttctctacattctttataacaatacataagtaccttttcggaggatggagatcctatcagatctatgagatggaggagatacaacttctattggctcaatgttaacaggatcatcaattcatcgctctctagagattttctcttcgagctcaatcaaccttccactgccaccatcctagataaactgattttttaagaatgtggcatgacaactcataatcacattataatcctctgaaaagtagaaaagtatcctaatgactctttaagatatcctataaagtgagcttttacagatctagcctctaacttgtccaccatttatcttttgacatagactggatatctctaaatcctaaggtgactcaggctcgatttcttaccatgccatatctcgtatgtagtaggaacgaatttagagaaaatcttatttaatcaataaattaaagttagcaagacatgtccccaaataaataagggtaaatcagtgtagcttatcatggatcagaccatatctaatagaaacttatttttttctttgatatcctgttgagttgaggtgtaccaggaggagtccactgagagactatgttattttttttgagataacctagaaactatctactaaagtatttttctctccgatctgattgaagaatcttaagagatttttttatttatttttctacctcatgtctgaatattttttgaacctttcgaaggcttcagacttgtatctcataagaaatacatacccattccgtgacatatcattagtaaagattatgaagtattgataatcatccttggttggcacatcaaatgggctacacacatcagtgtgtactaggacaagtaagttagtggccctatctccatatctcacaaaggataacttgatcattttttttaagacaggactcacagattgggtatgattcaaacctcactgagtcaaggatcccatcctttttcagtcggtttatcctatcttctccaatatggccaagtctaaagtgccacaaatacttatggttcaggtcatctctaggtctttagttcttatggcactaacagttttctcgttaatgttcacactcacatcaacatgtagatgataaacattgtcaatcaaaacaccacttgtaattaatttattttttaaataaatcaaatgatggtctttattgaaattaaatatgtaatcttcctgtgttagcatagagacaaaagtcagatttctgctagatataggtacataataacaatcttttaaaattaatctaaatcttgatagtaatgaaaaaaggtaggtccctacggtgactacagcaactctggctccattttcgattcgaaggatcatttctccttttctcaaccttctactttctattaaatcctatatagaagtacatacgtgtgcactcgagccagagtctaatacctaactagaagtagaagaaaccattaggttagattcaataacgagcatattagatatacctttcaaaggtgtgtcatcctttttagacttcaggttttttaggatagagtcccttgaactctttaaggttcactcagtcgtgaccaacatattgatcaatttagataaagagtagtcgattttgttcatgtggtagtttacgataaattgactgtatgaactagtcaagaattacaggatcaaatccgtttgtaatttcttctacatcgtgatgcccagcttctcaagctctttcaagtccttaatcattatccaacaatattgtgaaccaactgcccttcgcacatcttagaattgaagagtcttttggacacttcaaaatgcatagtgcagctctactcatcatacaacctttgtaggtgagttatcatagtcctgacagtaagtatatactcatgctggttctgtaactcgtttgatatggaagccagtatgtagcatttcatcctattgtcatcatctgtctatttatccaatgcagtcctttggtcagcattggatggcttggcataattgggtggtcgtggtcaagtacataccctaattttttagagattaagatcatcttaagatttttgagtcaatccttatagttaagtttggtcaattggttggactctagaattcagactaaagggtttagagctaacatagttaaactacgagcatagaaattcaagttagatatttgtaattgaattttatttgatctaaggactttaagagtcaaataggctcctactattttttcggatctctcatactctctggatagagaaataaaaatcctaatatgactttgaattttagtaggtactgcaatcctatctattcacgcacacctcaccgtgttcgattattggtgacacgcaaaatcgatgagtggataactcttgtctaatacttctcaagtatattgcagtgactcggtctctaattcatgaagccttatcgtgcttggttattggtctaatccttagttaagtcagatccatcattcaatgaataggcaaagtcatcattgggtctctaaccgtgtctggttattgggcccaaccccatctctacgtagcaacatcttatgttaatagggtggttatgtctttccaatgtaactgaatcactgtaaccagttaagaacaattaacaccggttggacgcctgcactcctacaatgatagaagacctatgatttaatatttgtagggaggtttaatttaggtctcatcttaattagtcataactattatgattaaccctattgatgtgggctagctcaaatcaccaagtaaccacatcaagactaaccaatcaaattggccaagtaagtgcaagatcggtaggggtccctctgttatttttcttagatatcaataaattggctagatcagtgatggaaccaactaaataatcatctttttttagatcgaatcataacacttttcttagacaccaatagatcaattaatttcgaataggttagtttgtgcaatttgggctcgagctattaagtcaaatcaaatctttgagttaatcgattcaacatgtgactattaatcgatatgaccaatctacaactactggattgatcttaagcactcttgacctaatcctaattaactcttgatgagattgggttaaccgctcatctcgattgaactccatcatatattaattgattatccaaaaataattgaattactagacctaattaaacttgccctcacccaatttcatgttttatgcattaaatttcagatcttaaaattttatttttagatctattaatcttaatttagattttaaaatcttattttaaaatcttaattaagtgcattatgaacatgaaattcagtttagatatcgaaacaattttagatctcaacataaaacatgtatttcatacatctagggcttttttttcgtggttcttcttcttgattcgtacaggcactcttttttgttagaaatgtaggatagttgcaagcataaatttcaaaataaatttttgaagacagcaaaataaaattagattaatcctttaatctctcatgcagcagatcaaatctattaactatctaagcccaatatcaatgacatgcatataatctaaaaattaaaatatagattagagattagatctctataccttgtgtgggtcgtaattcactacagtcgatgatccatggatttgatgaggttcctcgagccgtacaaacatctgacctccacaggtatccacacgaggttcgttgtttgatcagagatccatcgaagtctctagggtgttagctcccttgtagactttttctcttgatgcctgatctgaagtcttctttggatctctcagacactctaaaagacaaagaagaagtggaggagatgagaaggaagggaaaaaccaaagaacaattctctcttttctctcaaaacccaaactagaagccctaatatctcccatgccaagatggctacaagatcacatgccccactcccttttcttctctcttttagtcgaccaaggatggaatgaacatttgatttcacacctaataagaagggccttttaatgatggcgacaaagatgagaggatgagaacaaattcccatctgataaatatcaagttcaaacttgaattcaaaaccattttaaattcaaataagaactaacttgatcctcatccaaaggagataagggagtggtcgaccagcctttgaaaggcatgcaaatcctatgccaaattcagattggtgtgaggatggcgtggggattgggtggttggtgcaaaagttgaatctaatctgatttggactcatgtttcttccaatttggttcaaaccaaatcacatttggttagatccaaacagattagagaacctaatcaaattaagaattagattccatgaatcaaatcctaatctaattaggattctattgcaattgagtcatctcatagctcaatcaggccaaacctaattcaagtcaaaataaatgtaattcaattaaactcaatccaatccttattactcaatcaaatagagttaattaacaattcaattactaattaatcctcttaagaatttactaactattaataaattatttattataatttttgtatatgattaatcatcaatcaaattgacgattttatcctttaatgatttataatcattgatcaatcatttgatcagacaagaacctcttttgtgtgtgatctcgaaggttctattctgtttggtagtgagatatatgatgatttttatcactatatcattgaaactcttttcgatggattgaaataattccaactctgtctatcgaggatcatcgattatcaaaataatgctcgacgagtcttataatccttcaatgatatctaacagtatgtagtgacaatctagtagaataaaagtattgaacctctaggtgtggttaacatatgattcagtcgttctatcgtgagtcctgacttgacggagatcatggagaactcatcaaatctaatgtcaggcatatgcttgatcggctcgattcaaattcacttatgaatctcatgaaaattttttttcaatatctacacttgcttcgatcaaagattttctgaactcaatcttgctaatcgtataggactactcattttctatcaagatcgattccatctagatgcatcctactcttaacagtgaacctgaatttactgaagccaacatatactgcaaagatctgaatggctagggatcaagtttaggtgcagtcaaatccagtaacctcactacaaatagccaatgtatcataagtcaaaagattatacacaccactgcagtatcgagaagatcactgatgagtgaatagatatccaaatagtttctcatattgatcacgttcagtataagttattctctaataatcatctgtactctcatcctagtatccctacatcaaagattcgagacttatctatttggaagagaggtgatccatataccgatcttaaatggattgatcactgtcctccgtgacgatactttgatcaggagtatttagaaattaaccactaataatgtatgtcttaaatctcaacaccttgagaatatataaaatcatctttattaatttttaggataaatcataggtacataaaaatgattgaaaataaaaatattttttattaataataaatattttataagtataaaattagatcatgaaaatataaaatatgtcagtcaataattagtttctaaggcacacatctaatatttttataatatgtctcatccatcagagacagtatctgaatcagtcacaaagactagaagatagactttattcatgatggttgtgtagagctcaattttatcaaaccatctaatatatttctattactttatcaaagatatatctttaatcagagtctagatcaattaaaatatataaaataaatcttgatgcgtgttagtgtgagccacatctagatggatttaaggagataaatcacaacattatcaatttttaacataacattatttttcactgcctatgcataatcattaaatgcatactcaattttggctttatttatatttcttattaataaaagaaagaagaaaaaaaaatttagagcttgcttggtgtcatttttattatatttttttaattttggaagtttaattcaaagcaaaatgatttgatgggacagctttttcaaactaattggtagaatccccgaatgccttaaatgtgatggtttaagattttagacataaaataaaaatggaaaataatagacagctaaagttgggtacaaatgctatcctccacatcaatatacatgtaaaatttcataaatttgtacaaaataaaaataccaaaaaaaaaagaaataatgccaaacatgctttcaatggactcaaatgtatgtgtttgtaaaactcatttatatcttttgtaagtgatatcgcagaaaatgggtccgatgacatggtgcaattgaatttgttcaactcaaaactaatgtggcatttataaccaaatcgggtccatctcgatcgatttaacagctaggatgactagactaggggtgactagtcttcgaggtcatgcatcgccaacgtgccgagtaaagtctcacagtttggttagataatcattcaactcaacaatcattttgaggcgagctggaccctttttcttgaacaatgactttagcacctctatcatggcaagagttaaagatcataataactaacccagataattacaatatgtgtcagtcaattatactaccatcctagatggttataatatattttaaggtgattacgttgtaatccaataaagttatagtatatctcttagaagattttagattctgttactgtcgatctccccgcctgaggtcggatgccgaggtggatgtggccgaggtgaatccaccattggagcttcgttcgagcacttgcaaaataagtccataccgagaggggtgactccggtataaacccttcgatgtacaaatcaggagatggagaacgatgagaagagagagttaggagtcgattgattgcttacctttgaagggtcctggagtttttatttataagagaagagttggagatgtatccatctcagagtcctgacaaattctggatttgttacagagatagatttggagaaggactttcattttatgagagattggatcacaaaagaagttctttcttatctagactttctcaatttgaaaggtcaattctgcatagctcgactatagccgatcaagttagtcgtaacggatgacctgtaggtcatctgggatgatctattggtcgtcaagagtaagatcctgtcttgtgaagctgatatccatcttcgatagctcagctatgactagatcgacgatgatgaggttgttggggccgacaccaaggtataaacctacagcagatgcccccactctcgaggtcgagcttttaatagatcggcctaagagagtacttgatccaaggttgaagcataagatgatcgaactgttcatggaggacacatgtcaggaattgaacacctgaggtgaaccatctttgaatctaaagcatccattcttcgaatctgtgggagccattctttgaccaatcatcgggtgacatttgtcgaacatcggatggaggtaaatcgttagtagatcggtgccattctggagtcctataaataggaccatggtaactctcttttttactacttctactattcggagggaaaactctggcacttagcgattctgcaggcttgctcagcaaagtcaagctagttggtcttcctcattcctcatttgctcggccacttcacttttaggtcagtccctctctctttgatcatgagtgagtttagcttttttgccgacacctaaaatttggatgatggccctaggagtccaggtctcgagatattaagctcgagagatgatgctgagagtggtgctcttatgacgtggagctcgagggataatgttagggatgtagatcctgagctcaatgctgcttgctccttgggtagatccgaggtttcagactttggtccatataggactgactctgtccttacctctgaggacttagaaatctttatattgaaataccagattcctgtcgagtttaggttagaggtggccctctcgagtgaaagaatagctcttcctcctccgagccaagttggcatgtacgaggaagccttaaaggtcggagttcggctgcttttccactccttatagtggaagttcctaaattatataaaacaagtttctatagtattacaccgaactcatggtgccaaatcataggcttttttgcccattgcatcttccttggggtcaagccgatcacctatctttttcaagtctgcttcatttttaaggagcatcccacaaagaacgggtggtggtatatttcttctcgatggagacgtcgtctctttcgagctcctacctcagtacataattggaaagagcatttttttatctagatcgaacatcttcgggacttcaatacatcataggatagaccacataggtcaaaagttagagctctagtcttaactgaagccgaggagaagacattaaagcagatcttcagtcagaccccctctcccttagctgaattccttattgaggatactttgtttagggctggattaagtctagccgatctaaaagtgagttgctatttggtatactttatttattttgataatatttttattttaactaacctcatacgccatgtagaagtggatcccagagatttcaaagctcttaatcgggccatgaagaggaagaagataagtacagcctcagctccaaagcacggtcgtcccaaggtcattcttgtccaacctactactaccagagattcctcgaggccaagcagaacctcgaggagggagttggcagccttcgtgagggaggtcatgcctctccaatttgctaccccagggaaacctgccccccaggcctctgcatccttgtcgtagagaagttcaggcaggccaaaaattttcataaaaatgtcttcacgtccgaccaacgtacaggctagatcttttgctctagtcggagcctcctcgggtgctggagtttaggatactaggtcggtgatcaacaacttccaagtccggtctatgattcaatcaatccttcttctgatcgacgtcgaatccttcaatgctgaaggaggtgtctttcgtatgcatgatgcatacgactctctaatttgggtaagcgacgatcttcttcaagttactcaatgatgatagatttcaatatttaatactaattttttttagctcacccatcacatggactactacaccaaggcgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctgggatgatctattgatcgtcaagagtaagatcatgtcttttgaagctgatatctatcttcgatagctcggctatgactagatcggcaatggcaagattgttggggccggggctgaggccgaggtatagatctacaacaaatcccattgctatatattggtctcgaatttctctatcaaacatacgatactaataacaccactacattgagattttcatttgtccctcccaccataattaaaacccgttgctaacttaaagcattggaaggcctaactagaggcaacttcaatgagttctctagcttgttactgttttatagattaatggagataatccgcatcagtggttcgaagattagtagcaagagatcaacaccttctataggaatgaaatgaaagaagctatgaagcatagaagaaacaactacaagtgtctatcgatcatatccaactggcgtttgatggctccctatgcagttttcagagatctcaacctcctcaatcaacttttgagctatcatcattgaataatttaacctactcatctagtaggtgtaggctcttatagtggcagtgtagaatttgtagcagcaggctgttaacctctccgctagccatccgaaccattaggattgcccagcataggatatggtcacccttctctccaacaataccaaaggagcgatcatcttagctcttcctccaagatagactctatccctattgatccttctccataccattgcaagagggcctctaggagggaggtcgatcttgattgcaagatcgaataaatgaacaacaagatcacagcatggagggaaaagcatgctgaagtaggtgatgacttggagatgatgatcaagccttcctttagcaaagagattatggaggatccactgtcaaagaaattcaagatgcctcatatcgaacattaaaatggtacttcaaatcccatggactatcttaagagttttagggctctcatgttgctataagaagcaactgtcgtgatgtgccaagcttttctagctacggttagaaaagcctctcgattttgtagtactcgagccttcaacctggcttaatcagatcttcaatgagttagctactagctcattggccactttatcagcaatagaagatgcaaaaggatcttggttagcctgttctcttttaggaaaaagaaagatgagtcccttctagactttattaatcgatttattgctgagatgttagagatccataagttagatcaatctattatagtaacaacaatgatgaatgggctaaaaggctcatactttagtttttcattgaagaaaaggtctctcaaagacttggccgaactcttatttcgagcatataagtacatccatgctaaaaaaattgtagttgcttagagggaggcatcaggaggaaattaaagaatgagctgagaagaaaagagcaccatgcgaccaacaagtctatctcgaagctttaagaggcatattactcttaacactctgagagctccaattttgatggagattcaagattagatctacctatgctagcctcgaaggttgaatgctcttgtcgagaagatgggcatgagcagatgtaactagattcatgaagatcttgagcatgacaccaaagagtgctagtaattgaaaaatgagatcaaagctctcattggacaaggttaccttagtcactatgttgataactagtgaaacattgatcaagaaagatgaatactagagaggcaaagtgatgatcaactgattgccagagtaatgatgacctagctcattaacctaacaagcttataatcaagcaatccgagcaagggagtcaacttcataaagatcaaagccaccaagcaaagcaaatgtagaagctccacatcgagcttggagaatatatgtcgagtagctaagttcgagaagcttgaaggagtacctataccccaaacataaagccctaactatcctatggggcataatcaataagaatcataatatcagatttttgtatgctttatttttgattatcaatgaaattgtatttcaatttttttttgcctgaagctagcctaaagaatctaaggtgcagtagatcctacaacccttgtaagagctactgaccttgttggcagagacacgccaagaatgactaggacctctgttcaaaagttatactataacctaggctcgaatggaaggagagatcttggcctaatcacctaggtgccagctattcagaagaacccaaccgtttagacccctattggctactcaggactatggtccaaccactaagcttggagaggaaaaaggcccgtaggccaccaaaaaaagaccatggctataaagatgaccattggccattaggacctaagtccaacccttgagcttaggaggcaaagtcccgctgaccataaaaaaatggcctataggcataccaacaatgggtatttcgctactacaatgcacgagtcaggtcaaagatttttcgatcgagagatctcatctttcctcaggccgaggtgtccaagccaatgaagtaaggcaaacttgccccaaattaggaggggccctacaaaattatcgaagtcatcaagcttggaacctataaaattgagggcgttgatgagactcccatccttcaaatatagaatgccaatagggttggtaattggatcgggccggattggatacagattagattgatgcgagtcggggcacaaaattatcaatccaaattcaacttgtttattaaataggtcaaaaaattagatcttaacccaatttatttattaaatagataatcttacctgacccgcttgacccatttattaactagatcaagtcaggttaaatagattaaacagattaaatgagtttttaatgagttaaatggattaaacaagtcgaaataggttaagcagatttttaaataagtcttaaatagattaataggttatatatctaaaactaaattcaattcaaatattaaatggtttataccccggccaccaacaaaaatggctcaagaccccacaaaatatgcccatggcaactaagataagcctttgtccttcgaaaaataattgaatacggatatctgaacttgggaccccaacgactaagtcggaaaatcttgaccacctggagttatctcaactacagctaagacctttgaaatagcaaacaaataagcaccgatcacagagatatcctaacctaaattaggacctctgatgataaaggggctaaccctccagggaccttccatggctaattggtgctcctcattcatggacggatcgaatggaggttagagattatgacgaaagagctaattctctagggacccctcatttgccaattgatgctcctcatccatggatgggtcgagtagagactaaagatgaccatgaaggggctaatcttttggagacatcccatggccaattggcgcttctccttcatgcatggatgggtcgagcgaaggttgaggatgacgatgaaggggctaaccttttaaagactcctcatggccaactaacgctcctcatctatagatggattgagcagaggtcaaggatgatgatgaagaaattaatcctccgaggacctctcctgaccaattagcactcctccacagatggatggagtggaggctaaggatgatgatgaaaaggctaacggtcaggaacctctcatggctaattagtgcttctcatctatggacagatcgagtggaggctaagcacaatgataaagtggctaattctccggagacccctgatagtcaattggcacttctcatccatggataggttgagcggaggctgaggatgacgatgatagggctaacccttcgaggaccctttctctatggccgatgcctcttgagcaagtcgaggatgaatccccatcaataccctctggagtacgtaagtgattggataaaggatggcgtcactgacttggtgaagatgaaacccatcaccgaagattaattgaggttcattcccaaatactatgaccccagacttcggactcggactcaaactaggaattttcactccatcaatagctcgattagtccttaggattgatgacctcataagaacaaacaaatggttggtctcgaagatcgagatcgttcaatacaaggaatgttaaggaaaggttcattatcactgattcatttaaagaaagttcattacaataaagtttgttacaaaaagaaagtgtaaaattcaagctcggtcgacatccttgggcatggcgatgaagtcaaatcttgattagtagagtgcccgacgatgcttattcggagaaaatttttttgatagttgctagtccgagccaagggatattggggatggcatgcttggcccccaggacccatccatctcccaaatattcctcttaaggaggatcgaaaagctaacttgggggcaaaaggttatcctttagaaaggtccaagacctccctagggagctcagtgctgagaaggttccctaagcgattgctcactcctcgtctggatcataaaccgaggtgacctgacctggaatgctgcttcacgtccaatggagccgagtaatggaaggttgacctcccacagtagatccccctggaagtggtcagtcctcggtgacacctttagaatgatgttggccatgattctgcgatggtcggagcaatgatatttttcaatatctcccatatcaaggcacaatatttgcaggtgcgccctctttcggtgccttatggctaaccagaaggtaggaaaaaatcccttccttgtatggtgaacacaagcagttatcgaatccccgacaaaaaaatagggcaacaacatcacagcctcttcctctcatttatataagacctgggtggaagcatattgcttcaccacccaggtcatcatttgccatgtgtcacggtccagtagccctaaaaaagtcatgcctcttagggaaagatatccttggcacctctttcgacaaaatatcgttttaagggtttagggtattaaaaatcacatgcgccaaagccaccaaaccatgcggccctccgtcgctttaagcacgccatgtgggctgatccacagaatacgtgcaagaccaccggcgctcgatatatagcagctagaagcaatcttcgaaccttctttttgaaaccatagccctttgaattaatcactctttataaatatgatgagatttgtgaagcaacacattaatgatgtctcgagattttttttgataagtgctaccgattgctggtcaaagaaccagttcggtaatcgactatcctctcatccaaggctgtaaaatcacttcgaatttgaaggtagaggacgaatattgtgaaagttatctgccatccgactgacatcttcttctagggttacgatggagtactcaccgatgagaaaactttggagatccatgggaaaaaccctgatgagtatatggactgcgcttataggttccgctttggtgctttgagtcttggacagtgtccggttccagtgtcatttgctttcttctgaagttttgcagcaacaggtagttaccacggtagggagtggggttagaaagaccaatctgaatgctgcaacggtcacaggaaaacggcggcggtcaagctcgctcactgaccaagcaagtacaatgtattacgctaccgttcctccacgaccacaagaatgaatgcactcgctgggcctcttctttggtgcgcgattgggtgattcgggcgctggtgcatgaatgaatgatttaaacgtctggtccacgtagcatagggagtgaggcacgctggccgagtggggttgctgtaagcgggcgagaaccgttggaggagggggaagccaaagctggacccacggcctggtttttggtctggttctggttttaacttttaaatgaatctggtccggggtcctggctgtcgacctcttcaaaccatccgtcccatcaaccaccgccaaaaaacactctagcacaaacaagctagaccgttcataaatagaaacgattgacccatactacccaatcctggctgccccgtttcaggaggctctcttcgccttcctcctaccttctgagagagagagagagagacgaagagatcggttgatgtaggtatagcaatctcatcatcatctctccggtctctgctctttttaattgtgccatctccgtgaggagggagggatggcgtcgacgaacgtgaaccatgcgtgcccggcgccgatgaaggcgacctcgaacggatcgtggcaaggggagaacccgttggaagcgtctctgccgctggccatcgtgcagatctgcctcgtcatcgccgttacccgatccctcgcattccttctccgccccctccgccagccccgtgttattgccgagatcattgtaagcatccatcttattcctcttcctcttcttcttcttgttcttcacaagtacgtgcgtagaggatcgccaactaacgttaacgttaagaagaaaactagcttctccgtcgttaacgggggacggagtgttggaaattaagctctcatggcccattaaaaaggctgttcgattacctgagctcaccttctaccacccattttctcgctatcctttccccctctcgtcgaggtttgctccgaactgagacacgcttgtggagtcaaagcttcagcatttgttttacaacaccccccaccaccacccccccaaaaaaaaaaaaaacttccatcatttctcgccgtccacattttgcacatgagaaaagcacccacctagccgatataaagatcgtacaccctgaccgatcgatcacctcttcgaacgcccccaggggcatcgaagcagaatggaatctccatgtcagattcttagtgacgcggggagagggattgaccgagagagaacgagtgcacttcgtattcaaggggaatactgatgttcataaaaatttaatagaataaattattattattattaagatatggacaccaacaaacaaatattgcatgcagggagggatcctgttgggcccatcggcgctgggccgcagcgaaacgttcctggagacgttcttccccaagaatagccttaccgtgctggacactctcgccaacatcggcctcctctacttcctcttcctggtaggcctcgagctcgatctccgtgcaatccgccgcaccggcaagcgcgctctcatcatcgccatcgccggcatctccctccccttcatcatgggcatcggcacctccttcgccctccgcaccaccatcaacaaaggcgttgctgagggccctttcctcgtcttcatgggcgtcgccctctccatcaccgccttccctgttctcgcccgcatccttgcagagctcaagctcctcaccaccgacatcggccgcatggccatgtccgctgccgccgtcaacgacgtcgccgcctggatcctcctcgccctcgccatcgccctctccggtgccggatccatgctcgtctccctctgggtcctcctctctggcgccgccttcgtggtggccgccgccctcttcctccgccccgcgctagcctggatggcccgccgctcccccgagggggagcccgtcaaggagctgtacatctgcgccaccctcgtctccgtgctggcctgcgggttcatcaccgacaccatcggcatccacgccctctttggggccttcgtggtagggatcatcgtccccaaggaggggcccttcgccggggtgctcatcgaaaaggtggaggacctcatctcggggctcttcctccctctctacttcgtatccagtggcctcaagactaacgtggccaccattaaggggggccagtcctggggcctcctcgtcctcgtcatcaccactgcttgcctcggcaagatcggtggcaccgtcatcacctccctcctcgtcaacgtccccgtccgcgaggccctcaccctcggcttcctcatgaacaccaagggcctcgtcgagcttatcgtcctcaacatcggcaaggaccgcaaggtattaattaatttgtgatctatttaatttaatttaattagctagctacctcgctcgatcggatgtacctgtagtattagttaatcgattataattaattgattgatatattcaaatatgggatgggaattatattatattatattaggtgctcaacgatgagacgttcgccatcctggtgctgatggctctgttcaccaccttcatcaccaccccgttggtgatgaccatcttcaagccggcgcggcgggctgcgacgccgtacaagcaccgtaccatccagcgcaacgaccccgacagcgagttccgcgtgctggcctgcttccacggcagccgcaacatccccaccatgatcaacctggtggagtcgtcccgcggcacccggaagcgccgtctcaccgtctacgccatgcacctcatggagctctccgagcgctcctccgccatctccatggtccacaaggcccgcctcaacggtctccccttctggaacaggaagcacaacggggaccagctcgaggtcgccttccaggccttccagcagctcagcaacgtcaccatccgccctatgaccgccatctccgacctctacagcatgcacgaggacatcgtcaccagcgccgagcagaagcgcgccgctctcgccgtcctccccttccacaagatccggcagttcgacggctccatggactcggtgggccacgggtaccagctcgtcaaccagcgcgtcctccgctacgccccctgctccgtcggcatcctcgtcgaccgcggcctgggcggctccgcgcaggtctgcgccagtgaggtatcctacacggtggcggtgctctacttcggcggtcgcgacgaccgcgaggccctcgcctacggcgcccgcatggcggagcacccgggtatcgagcttaccgtcatgcagttcgtcccccagccaggccagcacttcgtgaacccgagcagcgaagggagcatgggccgggcgacggatgcaagcgagcggctggccgacgagacgtgcatcactgagttccaggccaaggtgatgggggccaaccagtcggtcaagtacttggagaaggtggtcggaggagggaaggcggagatagtggcggccatcagggcgatggggaagttcaacctcttcctagtcgggcacgcgcctcgcgtaatgccgctgaccgacaagaccgactgcccggagctggggcccgtggggagctacctggcacagcccgagttctcggcgtcggtcttggtgatcagccagtacgatccgacggccgacgcgtccagcctggcggaggtgacggcggacatacaggacctgccggagcccgacacgccggcggcccagatggaccgttcccgccattaatattccagaggcacggaggggagtgtttttgactttgcgcacgtgctagcttacttggtggatacaatcagtaaaatgctgtggtttttagttggtgattttatgtccccccaccttccccttcccgtgattaaaccacggtccatgcatcttgcggataatatataagaactgctcgcacgtacatgttgctccatgcgatgatatttttgtatctatttattgggttccagctagcagataaatcacgacgttggtgcgtcgagtgatccatctctgtacgtgttttacacaaaagtggaattagtgccccttatccgtcccaacaaatataattaaatttcatgcattggggttgcttgttaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaagatatatgaaatttgcactccttgtttggtttttttgaagcagttggatccttctcttcatttgagaatgtcccccttcctcgtgatccccaagagaaactaagaccaattcacacatagtttcatattctagtttgatagtttccatttgtaatcaaataaaaatttttattcgtcaaatatatgcaaatcaaatcataattttataaaaaaattattctgaaaatgttttggcgctctgctagaattagtgccgcataggattttttatttgtttaattgtttttttctagtaagccatgagactcataatcttcttcggtacaaattagggatggagagatccaattttctaattaattaggattatccatgtttgacataatgaccatgattagatagggtatatgatgtagcagcgtggatggttcctatatatccgattacaaccattcatgagcccctgattagaagattgggtctccttggttcatatgcggactcactccagttacgagctaggcgctcgtatggctcttcaattgtcattgcctacttccacagtgttatattacgctcacctcaaatcttccacgtagccactcataaggttccgccattgatgccactttccacacttaatgtcgcatagctgcagtccgaaagccaaaaaaagtcgaggggaaggaagaagcagagaaattgcgacaggagggcattttccaatttagggacacgtgataatgccttgtggagtttagtctcaagtgggaaatatttgttttctaaagaaagtccacggtgctggggcatctttgttaatgcttggactcaaaacgacggtggatgttagtcatcgagttcctgtagtttaattagacacataaactggcttggagaaaggaggcattttgacctgctttcagagccaccaaagcggtagctgtcaccagtataaggtcgctctcttctggagtaggggttgtatctctcttctgatgctggacatttcctagctcctagttagccgcgtcccttagccaagtcttggggaaatgggcaccacaaatttattctctcaatctagtattcattttaaacgtgcggttcggcatagcgacctcgaattaattaagtcaatgaaatgtacccctcttctatggtgagccattcatttgaagagcatttttaatctctctccaatcattcagcaccttccaagctgccacattcctcgtgttgttgtagctgacgacctaagtagaaagatcttgatactagaattcgcgcaattcgggctggccgcacgcgtggaaagcgaagagccacttttgacctctagaagtcgacatgtcttgatgagccaagatggattctttcatcattccctcagaattcaacgaatcatgagatttcatctcatcttcctatttatgcaacaatttcggagggaattaatgtatatggtgtgtgttggtgaggactgacaatccttctctttcgacttgagtcacacaagatgatctctttctggcccatgcgatgtaattaattgtttttccatgtcttcaaatccatcagcaaacctactccactcactgacttttgcttacaaagttagcgccaagaagtccatagttaatccactcttgtctagatcacgactgttcccggggtgcattcatgaacctgctagaagagagagatttacaacgcaaaccttcagctggttggtggccgtgcaaggggtatgtggcagggcaaactggccacacaaaaagatgctacacttaggcccctggtggaattgcgctgcagctgtacatagctttctaaagggcttgcattctcgatttttctactctccaagaccacgatctttgattcgatgagatggatgggtggagaacaaaatgtttccaccgaattccactccaagtccagaggatcgccactacctcaactggaagatgcccatcgtgacttttctgatcgatgcggaagtttcttctattcttgaagtttcttcaacggtgtcagatccttgggtggcccctgtctcaagtcactctatgcagcccatgtgtctcggtccaatcctgccaaaaatttttggatacaacacaaacacggttggccacttccggtgccaccctcagccgcagcgaattgagttcacgctcacgcggacttgaaaaactcattcccaccaaacatggacacggaggactttgagactcgttaacttatgatccacaaattgagagtcttgctgcggtgcagatcaaccagatcgcacctgggctgtcgtgaaccccttatcacatggttttgaagacctccagggccagttgctgtcaaacagatggcttccaacaccaccatcaacattgccttgtggctggggctcaactgcgcagacggatatgccaggactcgatttcattctcattaaaatttgtcttccaggataatccttaatatgaagtaaaaatgtggcgaacatttttgtgggcccgcaattttatggtgggacggctgattgagacctggtttgcttcctatctgatcacaagatcagggaaaaagccatgcgcgaaaaagtgtaaccgtgtgaggttcctttgctgtggcctgcggaatagttcatgcgggtccggtgcatgaccaatcaattatgtagtgttcctaatttgttggtagtagagcccgtgcggatttatcacagctcaagaaatccttgtaaatggcgcctaaaagtgaaattcccatgggatggatatacgagttcgaatcaactccagattgaacttgagagatctggcattttttcccccctccgttacccggcacccatgtatcattgtagaagggccgcgtatcgaatggaaagttggataactaataacatatatgtgctgtacccacttcgagttcatgatttttgatgcaatcaaaaagatgggcagagaaaatgatgcttccatggagcagagtttgacaaattctgatccactcccaagtcctctgctgtggactattcaagtgtgggccgttattctcccaggatcttccttatgtcaagtggaagatgctattgctacccactgttttggatgcaaaagtttctaatgttctttaattaggccagacagggtatccttatgtgggctagttgatctgattttaaaactttggatgtgtctcagcaaaaattctttgtgcaccgcgggcagtgcaaaaaatccgacgcagagtgcaccgctttatatgattgatctacgtagctaccactttttaatgtacatttaatgcctgtagttttactttttagtttaaaaattttgtatgatgaaaatatctcgagaatttagaaaaaattatgacatcctatagtatattatgaattcctatacgcagaatatcataatatgatctagaaaattaagatattctgtagcatattatgacatcctgagtcaaattatgactttttacatgcaggatattataatatggtctacgatgtcataatatagttcagaatgtcataatatagaaggagcatttttatccaattactttgcaatactaaggctggaagtggattcggaccgacctgaggtccgtcgagccgggccggcttcgggtcgggctttgggcttggcctaaaaccatttaggtcgggctcgggcccgggccaaaaaataggatctgttttgcttttgagccacgcttgggcagacctttggcctggcccgggcccgagcccgagctcgagcttcaacccgaatatccgatccgagctcaatctcctactcaaattggtttagtccgattaccctatctgaattagctcgattttaattaattaatactaatttgtttagtcgattaaattgaaaccttagccctcccaatccctgtgtctcgatctcccccgttgtttcctcacccaagaaaaaaggaaaccaaagccctaggcccctagctcttggtcgtctggtccatagccatcgtgatcaccaccacagccactgcctgatcccaaaataagaacaggagctatgatgaagttggtggcaatagggaaaggaatgatggtggggtagagcttgaggcgagcggagagctatcgatgttggggatgatgaggcttttggggggtggggggaggagtttggggtggagtggggtggcacagtcgagctcgatattcgtgacgtgaagtcggagcatggggcgaccgacgagggcggaggcccgagcgggggaggaaggggagccgttgtcccccaaggtcaataagaacaagaataagagggacacaaagatgtcgaagtccagggagaggctaccgacgatggcggagcggtgtctgtgcctctagaggtcgctgtttagctgcgtgttcatgttggtgggatatctggctaggacaccatctttcagaaccttttcgatatcgcacgatgcagcaggaagaaagaagaaataaaacaaaaataatcaaatacatggatcagccaaaaaaaggcatgcctccatggggcatgcaaacttcactatgagaaaaataaatattataagagaatatttcaccatcaactctcgtacatccaatttctccctcacagaaaattctctctcataaaagctctttctctagaaaaaccctctgaacccctgaaacgatcactgttcgctgtccaggagcctccctactccttctcttagcgtcctcacatctctctctcttcgcatgggttcactgtttttgctgaagaaaaccacgccgccacaaaactgtccacgccaccacaccgctctgttaacaaaaatagggcttttatagccttaaaacccaataacaataggattaggactcttaagagcacccaaagaattttttcggaccattggaaagaaaccggaagcaacccatgccctccaatcgcgcaccgatccctgaaatagtccgtgaaccatgagaaacgcataggaaacgcccatgcagtccatacgctctcctgtgcaccgctcgatccaccgtggaccgaccaatcctgggctctgaacctgtgcacgagcgcgcgtggacctgggccacacccgagcctgtgcgcctgggcttgggccgcgcccgggcctgcgcgcctgggcttgggccatgctcgtgtgcttgtgcgcctgggcctgggatgcgccccacatgctgggcctggctctgcgcacccaggccacacgctgccgtgcctgggccacacaccaccactcgcaatcgcgccgccgccgctccaccggcccgccagcggttctccaccgctttgagtttcatgctgacttcaatcgagcatatctcgaccatccgaactctgtttggggtgatcttagtcttgttggactccatttatcatcatggatctcattgtgggctcaatatggatcgaattttgaggcatcaaattctaacaatcttcacttcgactagatattcgatctctttctgactctgagagcttctgtatctcctcacccccatgtcttggggcaatcgcctgctgatcatggatggacaaacatgggagtcgagtcaggctactcgatcccattttcattgtatgctgtgctcctcctgatcagagacctaattggggtaccattttgcggcaatagaaatctcaccttgcggtatcgcctttcatcctctcgaatctcctatctcgtgcctgatccacctgaaggaaaaattgtcttttttctttgtaggatcttccagattttatcaaatctaggatggaataatttaaaatttttatcctacgctatttcagatctaatgtctgttagatctaattttattatctgatatttaaaatctaaaattaaatctaaaagtataagaagtatagacatacctcaaggataatctgattactctgtagatgatctcagcacagtccaaggttctgatgtagccatgcaaatgtctggcctctaccggtatccactcagatcgaacctggaacatcttttcttcgtgaatctacgcttcaaaaatcagatctctatctgatttggaagtgcttcagaactccttctgaagttggagcagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagactcttcgtcaggtaataatatcctctcatcttcttcttcccctccagaacaatcctatcgccgcatagcaccttcaaaatttctccaccagctaccatttttgtagcttttcgaactagtctgctcagtgagataagattctgtctgaaattggatatgtatcggacctcctccaatctcctcactgcatcattatgtgtcctccaactgaccgtcctgacgcctctgatcacatagctcgatccatccggcaaacaaacagtaccctcactgttctctaaggagtcaaactgcttctctctacaacatacatgataggtacatgtagaatttaaaatctactactggaaagaagtagatacctcatcagatatctccaggacatctccctttgaatcgctactggccatcgctacagcagccatcgtttgatccctgagttgagagcaatctctggctagatgccccaactcgtcacaccggtaacacctgattttgcttaagttcctcctgaacttggaccaccctcgttataatctcttgttgctccatctacctcctccagatcctccaaaaacaccactgctgagctgccgatacttgagctcgaagttggtttctctctcttgagaacctcattctagagtatcgccacagtggcttcatctattttgatggtgctcttctccactagaagagcaatcaccaaagactcatacgaaggtagaagcgacgctagcaaaaccagcatcctagtcttctcctcaatattcttatcaatgttgaggagatcggtgaggatcttctagaagtgactgagatgctcctgcatgctttgtccctcagccattcatagctggtaaaactatcttcagagaaaaagagtgttggtgagagatttctccatatacaactcttcgagcttcgaccacagcaccgtcgaggaagtctcgccaagcacatagatcactacctcatccgctaggtacatgcgaatgatactcaccgtctgcatctagagccacctccaatcctgcacctctatggtggtcggcttctcctagcacaagagagcattgatcaacccttgctggatgagcacgttcttcacctttgcctgccacaaggagaaattactcttttcatcaaacttgttgatctctatcttgattgatcttgtcttctctatcttcaatcttgctcaccactgctacaatctgcgtctttgtatcgcctcgctctgataccacttgttagtgggatatctagccaggacaccacctcccaagaccttttcgataccgcacgatgcagcaagaagaaagaagaaataaaacaaaaacaatcaaatatgtggattagccaaaaaagctcgcctccacggggcatacaaacttcactatgagaaaaaaaaatattacaagaggagatttcaccatcaaccttcgtacatccattttctctctcacagaaagttcttcctcataaaagctctctctctagaaaaacctcctaaacctctgaagcgatcactgtccgctttccaggagcctccctgctccttcttctctcagcatctcatgtttctctctctttgagtgggttcactgtttctgctgaagaaaatcacgccgccacaaagccatccatgccaccataccgctctgttaacgaaaatagggcttttatagccttaaaacccaataacaataggattaggactctcaaaagaacccaaagaatttctctggatcgttggatcgaaatcggaagcaatccacgccctccgatcacgcatcgatctatgaaatagtccgtagaccacgagaaatgtatggaaaatgctcatgcaatccatacactctcctgtgcaccacccgatccactgtggatcgagcaatctcgggccctaaacccgcgcacgagcacgcatgggcctgggccgtgctcgggcccgcacgcctgggcttgggccgcgcccgcaagctcgtgcacctgggtctgggctatgccccgtgcgctaggcggggctctacgcgcctttgccgctctgccggcccaccgtcgatcgccggcggtcctccgccgcttcgagttccatgccgacttcaatcgagcatatctcgaccactcggactccgtttggggtgatcttggtctcgttggactccgtttttcattgcagactttgctgtgggctcaatatggattgaatctcgagatgtcaaatcctaatagttcaacggttggaaaaagagccctgatgggcagccatggcagtctctgtggtggtggtggcggcagcggtggtccagagggagggcagggaggcctccgacgaaggggacatgggggagaggttctacgcagcggcgatcgtcggagggagggacttgaggtggggcctggaggagcacccaccagttattgatggagccaggggcggcactagcgatgacgtcgatgagtttccagtagatatcatggagcccagcgaagctaagcaaaggaaggcagggcactcgagctagcccaatcaggctcgggctgattgttttccaaaataattgtgcctaacttcggttcgaagctcgaaattttttttttttgagctaggctagggtaggaatagagcccggcccagcctaatccagttccagccctatgtaacatgcatttaatgcttgcagtttcactttttcatttaaaaattttgaatgacaaaaatatttctattttttgaaaaaaattattacatcctatagtatattatgacatcctacgtcaaaattatgattttctgcatgcaggatgttataataaggccataagatgttataattttttttcaagaacagagatatttttatcatttaaaaattttaaataaaaaataaaattataaatattaaatatatattaaaaaataatgattacaaggatcaatgatataaagtgatatacttcatgttagatttttctgcattgcttgtggtgcatcaagaatttctactgtctcagcttggttgtgtcacgccggatctggaatccatcagctcggccgcatgacggcctgatggtatattgcttagattggcccagccctgctcacaacttcggatgaagtgaccctgcctccagccttggatccgcgcctgagagctgcaattttgagacgtgtgtacgattcctgatgcggatgaggtgtctgatggatacggtctccatcgtgcatcacacctaaactacaccgtagcgagataacgacctaccctagccttttcatgccatcacatgtgaagcccacgcattaggctcccgtgctcagaggagagcagatatggacgccgcaaacgtttgggacctctaatgccaatttcccgtccacaaagggctaccaacccagcagcgttggtccgtggtcgattggggtttaactgcatggatggaatataacgcctaggacaacccgggctagattttgtgctccttaattttgtccaccaggattatgctgccgttgtttgtagcggggcatgctgacgcatgggaacgcaaatgctgcctgaacattaaagggctgcttacatgtgcacaaggcaatacacatgggcatagcatactagcaaggcccatgaatttggtgtgaagggtgtaacaaagtgccacgtcatcatgtaactatccaaattggaggtgggtgttccgcgttaacggtactccaaagatgagttggatttggccggatctgcctttgcgttactgtgggttgaccaattgggaccgagtccaggcccaccaccaatgttgtacagcaaaagcgttggcatcagaccacttgagggcccatttttggatgacaactgacaagggggccaatttcgtttagggcccatcaaaactgaaaaaggtgccggatcattatcgctaattagtttgtaattttgtatgtaaaaacattagaacaattttcttttccaaccgaagcattaagaacagttttactctatcatataattattgggaaaaaaaacaatcattatgagaaaattgagtttgattaaaaaaaaatttctaaatgcttttttcctgttttgtgcctttaatccaagagtgtgatacatagttaataaaaacttgtaaaatgaagtgctttgcatatgtaagccagcttatcagatttctttcccaatctccaaattgtaagttaatatgaaaataaactaggtcatttgtcagtcgagttgtttcttatatgatgaaggaatatttaacaatcaaacccttacaccaaatatgactataactacatcttgataaagctccaggtcctgatgatttttctaattttttctttcaatatttttgacaaatcattaaaaaagaggttgtagaagctgttaaattttttttttcttatggctttatccctaactcattggaaagaacatatattgctttaatccctaaggtgtctagtccagttggagttactaattatagaccaattagcttatgtaacaccacctacaaaattattgccaaacttttggttaattggttgaaacctatattacctttgctgatctcaggggaacaaggggcatttgcgcaagaaaggaatattcatgaaaatattttgttagctcgaaaaataatgcattctcttcaaaaaaatctctccatctagaagcttgatgatgttaaaattgaatatggagaaggcttatgatcatcttcattggccgttcttatttcaaacttttcaacactatggatttcataataaatttcttgcttgggttaaagcttatgtcgacaaacctcagtttgctctttttattaatagaagcattacttcttgattttttccaactaagggttttcgacaaaggtgtccactatcaccttatctttcatcttttgttctgaatttttttttagatttttgcattgtgctgttaatgctactctgctgagagcttacaaacctagagggggaccgataatttcacatattttctttgctgatgattgtttgcttatttttctggtaaaacttcgagatgccattattattaattctattttacatatttatactttcatatttggacaagcagttaatttttctaagttgcatataattttcagcccatctatatctccaattatcaagcatcaactctgctccttgtttgatatcatgccacaaaatgatacatggaaatatttggggattcctatctctggacaagcttacaaagtttctaattttgcatttattatggacaaggtatcatccaggattgctagttggtctcgaaaagtgttatctcttgtatgaaggacaactctaatttcttcgtgaaggatcgaaactgcgcaccgaatcgtcaaagttggaggcagcagatttcaaaattttttcttccgacccggcatgcaaaatatagatctaaatcatttatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtgggtagatgatctccgctatccaatgatcatggtaaaagattcttgaggagctgcgcacttgtccaacctctgcggatattcactctgacctggcctgggatgctttcttcggatttgatccgcctatgctatggtggatcaaatggctccttgatcagttacaaaactgatctctgaggggctgtcaaatcaatccttgacacagccttttcttccttcacttggacggcgcctgaactccttcaagcgtacttcaaggattggcccaactcctttgggcactaagaggggcagcagcctaacagcttaggcgttgagatcggagggaagtggaggtggaagagaagcagggtttcggatctaacacttggatgccgaaccctttggcaaggggtctaatttattgaccaaaaccctaaccacatgcaaccaattttggtggcaccttttgaaatcagatttcaaaaagggtgcgccctcacaactctcatttctgccctatccacaaggggcgatgccccttagtttctctttgaaaaaaagaagggcggaagcccatttgtcttaaccaaaaaggaagtgtgtacgcccatgatcttatcttggcgtgtgtcctcttatcccattcaaattcaaacttaaatacttaaatctcatttaaattcaaacttaaattcaaataggactaaccactctatttaaatttaaacttttcaaacttaaactgaatgaggcagttgccttcatccatgtccacctacgtgagactttctcatgcagtgatttatgagaggagagaaatggaagggggcaccaactcttggcatccttccacgtggatccacaagggcatgcatcccttgaccaagtcaagggaggcatgtgcccttcaaatttgaattagattcaaatttaaatgaaagaggcttagtgcaaccaactattggtatccaatttagaatccaaatagattaggcttagccctatctgatagggaacccaatcctagagaaatctagatctaatcatgtgctagcatgattcttttagacccaattaaacctatgtgagtctaattaagcaatcctagaccaaagctcttgattgtgtgacccaataggttcaattctgcatggtaatgggatatattgtgatctctatcagtaatattatcgaaattttttttgatggatcaaaactcttttcaattcagctaattaaaattattgattatcgaaataattctaattgttccataatccactagtgacacctagtagaatgtagtgacaatccatcagaactgaagagatgaatctctaggtgtagtatcgtgtaatttggttcttctatcgtgcattccgataggatcgaggttaaggataactcatcaaaccttatccctatcatatgttagaatcaatcggttcgagtccgatatgaaaccttatgaaaatatctttctatattcacactactgtggtcatgggctttaagactcaatctcatgatctacataggactactctttttctacctagatcgataaatcccatcttggtgtaatctaattcctacaataaacatactgcagccaacatacacctcaaaggtctatatagctaggagaccgagttatgatgtagtcaaactacagaaccctcaagatgagcagctaatgcaccttaagtcagaaaactacacactattgcagctttgagtatgttactgatgagaaggtaaatatcctagtgactactcgtgataggtcatgctcaatatctttgttcctaataaatacttgcatttttgttccgatgtctccacactgtagattcaagactcatctacttgaagaaagcgatcatgcaccaatcttttcggatcaatcattatccccatgatgatcctacgatcgaaaataatttatgagttaactaaaattaacatatgtctcaaattttcaactattaagaatatgtgttatcatatccattaactcaatggacgattcaaagacactataaacacaatataaatggataaaaattcaaattttattaatataaaaatcaattatacaaaatatatcttaaaaaaattttacgagtgtcgactaatctgacttctagaatatatatccaatacttcgatcttggcttctattcctttacattctatctcatgtgttcctgtccttattgctactcttttgaagcttgaaaagaagttttgtgctttcttgtgggggcacccttcagaccgcagaagccttcatattatctcatggagccgttttgcatgcccaaaaaacatggagggcttggtttacctaatctggttgagtgccgtcaggattgcttgtgcaagatggctgcttatctagttctacaaccgtcctcgttatgggctgaagtggtaaatgctaaatacaattttaaaggaaggtgggactcctatattgtgccttgaaactgttcaattacatggaggaaaattgcttcatgtggtaaactgattcaaaatcagtttcaatgattaattggaactggtcataaggtcagtgttcttaatgatccttgaatgactagcatacctctaatcaaatggccagcgtacctgaaccttatgatcatctatggaattctcggattcttgaaaactgtttctctgctgatatgatgactcagatccaaaggatccctcttagtcatggattctgggctgatcagctagtgtagagtcacactaaaacgattcatgtttctctgtctaatgttaatgcagtttctcataatcctgtgtctgtaggagctcccaattttcaatgggtttggaaattgaaagttcaaccaagggtccaaatgttctggtggagattagcttggagcaaattgtcttgtaaaaaagtgctgtctagaagagagatgattccaaataataagacctattgtgaaatatgtcacctggccgaggagaactgtgatcatgtgatcgttcagtgctcttttgctaaagaatgttggacccaaatgaaatactttagcaacaatgatttctaccctacctccctatcaatgctgattgattttttgtctaatgcaaagatgggagaggaagacaaagctttgtttgctttgatggcatggcatatctggatagctcgcaatgagcagttgtttcagcaagtagttcagtcccctcatcagctaataataaagaccattgttaataacataaggtttgggcatcataatatttccaaagcctctggcatcccgtcaaggtactgggatagtcatatgcagcatttgcaaccttctaattcatttaagatggtgttgtgactgcctccttcctctgggatgttgaaggttaattttgatgcatctattaaaaataaccaggcagcagcaggctttgtgattagagatgatgtggggagattggttcgagctggtggcaaatctttgctgccttcgtccgtccctatggctgaacttactgctgcctggttgggactcaaggtttcgatgcaagaatgtagtgctgaacaaatttggcttgaaggggattcctttacggttatcaactggatcaaaaattctaccagctctaaaatgcaacataaccctctcttgcaagatattttggcttggaagacctcacgattagtatgctatgtctctcatgcttatcgtgaagctaatcaagctgctgatttcatggcaaactgtgcgctcgagggggacataacgtggaaacatggggatttccttgattcaacatttgctgctttacttcaagctggtgcatacaatgtcatgcatattaggtggtcatagcaagggagatcatcttagctattgggtggctgaggtgacattaatttggagcatagtactctattggttaggtcaatgctgtttcatgtgcaggtttcaaggtgagcatagccatcaatctgtgtatcacaggtacgaatggcacagctgtaagttatggtgcccgagaaatgaaaggagatcaattgcaagctacattttcattgcatctatatatatttggtctgaatttaatattcccagtcgtctatcatgttcaagctatcatacagtatacactgaaggcattaattcaacttttactaatctggaatgcacactggattggtggtcaacatcaattttctttcattggaatgtccagctctggtaagtaattgattgttttatagttggctggagccatgaattaatgtggttatgccggattctttatgttgtttatgatcaactgcaaaagatagcaagtcatgtgatgagatggcattgttcacaaggcttatattctatcatctcaatacagttttatgaacagcagtcttttatcaaattggttcctggtattgaaattagtctggcccctacaggaactgttagaatattaacactactgaagacccaggcgcaaatgcaatatatgtggctttgttggatgcaggatattattattgtgatcatctgggagagtgagtatcaggctggagtactcaattactcaagcaacaaggttcacactctgagaaaggaaatgacaagcaatcaaaacatgcttctctgtttcagaaatcagttgcagagtttttaatcatggatataatgcactgttcaattgtttcttatatttgcttcctactgccattacatgtctgttagatgcaactatgcctcatgttcttccattacttatgcctcgaatattaacaacgatattctcctatctaccgtggatggtatgctttgtctattatatctccgcatcaaaccatgttacagaaggatgaagctggatcattataatatatatgttagtatgtggaaacagctgcagaaaggacacaaaatttatcatcttatgtgcaggtctacaggggcattgctttatttcaaggctaatcttcaaaataaactgttgcaaagacttctactgctacaaccatctactaatatggcaaagctttcaaattggttgttttgccataaggagtatctgatttcaattgatgacaagcttctatgtatatttcatagctctggcaaatgcatctatggagtctctttatgtatcgccataattttttttttttgtccagcagtgccactgcctgattgcttcatcccagtgctacaggacaatgagatctatcttccaacagctctatcatggggaattgtttgctgcacaccttacattaattttgttttaagtcacactgctgttctctttttaataggattgttttggttcagctgtgtaatatctattgtacctttcaaacacttgtacgctggttttaatatttaagtgatagctcctcttcttaccccgccccccccaaaacccaaaccaaaaaagaaactagattacgtgttatgcattgcaaacatcattagcatccaatcaaagagtttgtcctaactataacacaaccaaagttggatttttaattgggtcgaaccagatctttaatgatgatcaacgattaagccaaaccttcggctcagtccacgagacagtctacaagacaccaaatgccaattgtcaagtcacctgattttgatcaaggaattgcctaatataacacatagctttattccaaggtagcagtcttcagcctccaaaaccatcacattggactgaatcgggaaaaaaaaaattcccagccgatcccatttatttatgttggaggaagttgatgaaaaacaacatttatccaaaagaaaaggaaaatggaaatcctcagtttacctgttactggttttttaaatttttttatttttttatgcgaagggaagcagggccacgcataacttattaaaacgaaagtgctattcccacagtttatttatttatagaaaaaaaaagtaggaatagaagcatcagagatagaagcagaggtataaactcagagaaaatatcccatggtatggatgtagacgggcgtctgaatttggcattgcagcaggagcaaatagatttatagtaacagtatcatcctctagaaacacagcatgtggaatgttcaggtggcgtgaaaggggataaggacttcaatttgttccaaagagtggtgtgatcttctacggtcttaatagagcacaaatgcccttaggaatgaaagtgacatggtatataatcagtctacctatcacgattggacacatggcaagcaattttaaatatatttgaattttaaatggaaaaaatgagataaaaaaaaaaggagattatagtagatttaaatccaaataaaaatagaggttacagcaatcccttaatttctacctccaaatcgtaacggatccatgcttctgaacctatataaatagggccaaggggatcctaagaggatagattaagagaaagagactttcataactcaaaactctctagccctcattcattatcttattttctttttttcttgtaggtctataggtttataagcacctgagaccaagggtgatgcgaagatgatgcccgagttcaagatcgagatcgaggtgaagactaagcctaagactgaggtcacgaataaaccaacctcagaaagtcgacatcgtcaaaagaccaagaacatgagaattctgacttgaggaagttgagatcatcagaaggttaaggacatcagaaaatcgatctaaaaaggctgagatcatcagaagattgatgtcattagaaaactgaaatcaaaagatcgacgtcatcagaagatcaaggttatgagaaagtcgagatcatcagaaggtcgatctaagaaaattaggatcatcaaaaggctgatctgaaaagatcgagatcatcagaaggttgagatcatcagaaaactaagagcatgaagaggccgatctgagaagatcgaggtggaaagctgatttgaggaggcctaccggatgtagcagacctaaaaaaatcgaggtggaatgctgactttcaaagactgaccatccaaaatcaagctccagtctgccatcctcacccttatcttcctcttccacttctataccctgcaccactatagtgttgatgtcttcattctcacagacctgattggtgctcttatcgtcagatccctcgatgatttttgcttctttgttggcccctattttgttcacccaagccatcggattcatcgccttgcagccattgttgttgttgtttttctcttctccttgcggccttacttgtcacccccattgatttgtaaagaccgaggaacttgcctccatcctaattcgattcatggctccttgatgaccctgcagcactatgatgagttactatccaccactatgttgtccttgcaagttcgtctttctcatttgtcaattttcagattagaaaaatttaaagagagtttttttctatttatattggtgtgacgagttgatacatgtggcggatagagattgatcttatgtatcgtcaaatttaattaagatataatttttgaatattcacgaacttggttattattattattattattattattattattattattattattattattattattattattattgaagaaagcagcatcattggaatagacgggggtgctggacattgcccgaaacgatgagggcattttcgtgaggaaaatgccttggctttccgggcaagtaaagaaaggaaaattgcgagaagggggctgttttcccaaatacgatgaggcttttgtccgcctgttttcgctttcccattttatgtccgcgtctgcgtctgcgtctgcgcgcttgtgcgcgtgaactttgaatccttcgcttaccaacaaatcacaaccaaattgtaaaccctatccttttcttcttcaaaaaaacaataataataaaagaaaaaagaaacaggcatccatcagtcttcccttttgttccgccacgtctctctctctctctctccttctactcgccgccctcctctgaccaccaattccttgtttcctctccatctaacaagtgttcgttcgaagggcgtccgctgcctgctctcccacctgaagaagaatccttgcccgctccccaggtattgcaaagtctcctactagatatccccctgcttctctttctttttctttttcttattttcctctattcgttgattcgatgatcgagaactctgattgtagcggagacttaaactctgcaaaaggggctggctgtagtttctccttaatttgattttctttctttttctttttcttgttttcctctcttcgttgtttcgatgatcgggaactctgattatagcggagacttaaattctggaaaaaggggccgtagtttttctaattcgggtcctataaaataggaggaaaaagagaaacgagaatgaaattctagaaaaaaaattttaaggagagagaaaggaaagggaaatcttgctgaggtccgaagcaaatagtatatgtgcctcaacgagtttatgaagttgctttattttgaacgctctcttgatgatgagtccttgatcctcacttaaggagattgtggagcgtttagaggattgtagaaaccataattgaatgctcgaccgcttaaagcagggacggagcaagtgcagactcgggtaccataggaggatgcagttccttttttcataacactaggaagtgcatgtgttaatttccttgaattggtgcaatgttgtgggcttaaattatacgactttatgtattctagaatcttcagaagttggtaagaaaaagtgaaatctgtgctctggtagatattctaattagttaggtcttggtggcccacaaatgcatctcagcaagaaattgttaggaattttctgtatctccaatgcaccgtctttgtcttaatacatatgtgcattcgtgtgcgtaatttgactgaaagtgaattagttagatcaccagttattctttcccagcttgatgttgatcaatgggcactcttaaaagtttttcccgtggtactaaaaatgagataatgtatcatttgccccttttcttctcaacattgatctggcaagtatttgaaatgtttttatgccttgatgtggcttttggagtagttgacctagtagggttagcatattgacagttcctggaatattataggagtaatatgtcaaagtgaaacttctcttgcctagtttttaaatgcaatgccgtgttaaagttttacttgctgtcttgtagacaagcacatagggaaacatgcgagtccgtgggcctcttttgaagcaatgatttttcaagttgtaaagatgtggatcaagtatttgatactgaatattggcatgctaggtttaggtaggatacaaccaattacttctttctccttgcttgtgatccaggtatgattgtcaaccaaataacaaaatccaaaggaggttcctttggatgagggaagaatgtctatgttgagagttatcatgtagtgatttagataatgatgctaggactaagaggcaatgggcttagagatggtgttttaagaacttagaacttttatattatgaatgttgttagagacctgagatgctttgggaatacttacatgtggcttcttgggcatgcgattataacaaaatactaaagtatgtgaccttcatcattcaactctctatcatgcaacagcttttcctgattgtatataggaaaagttacctaaatcttaagaaagataaaataaataacaaagcttaattgaaaagcaacgaatttcaaaccaaaagcaacttaaagtttccataaaataacatattatcatgctaattagtaatggcatgcttaaactttgaggaattttcagcctctatgatgatcaaactaagagcagttaaggaccagaaagttgtggactttactttccagtgagtaataacacacatttaaataggtaaattatcaattgaatgcctccatatagacattaggttcatgatacacatgagttgcattttttgttggcattgtgcccccagcttcatcagcctaaagttaaaactatgaaggtgatatttttttaggttcatttggtaatttgccaagcttgaagctttatagtcttcatcatgtgaggtctctcattgatgtctgtatcctgaaacaccatttcagctaacaccctgatttacttatattcttgcattcttatgctttgttaccaaactaccttcctcctcctccattcttgtagaatcttggtctatgatttaccttcagttttatttttattctttttttctcttttcatttttttttgagggttgccagggtgaaggttggttcagtattcactatattttttttcttcttgattattgtaaagttagatttaaaactctttagctatacttatttagtgtgaagaagacagatataccatgatgctaatctccagtactacaatcttgagttaaatagctgacatgtgattgatttatgtcaagacaaaagcccctttttattaatcatgacattatatgagttttcccccctaatgatttgatgaagtgtgttgacaatcatacttaccagctataactgaatgaaaaatgaagacatgttcttggagaaagccagatggcttggtcaaggcaatgtttatcaaaatttaaaactgggatctttctttggaagataatagtaacatagggatgtaatttgctaaagtcaagccctttgtcagcatccaccattcagctcaaaatttgggttgataagggatcgcttgattagtaactgagctgagatagagataggcccggctcaattgagtttggcttgatgatgcttgaaatccaactaataatttattattattctaacaattatctatagaaaaagagtaacgtgatcaacataatgtagactacgtttctatctaacaaatagagtagaatgtatttcagttataatacgaagatatggtagtggaattagcttaaaagtatatgaaaacttaagaaccttaggctttaaccaaatctcttaaaagaacttaaatggctcgaatttgactcaaatttaaattggatggcttaggctttgctcattcgtagaatgagccaagctggagctgtttaagttaaattgtaattttagagagtccaaagacaagcaacagcatttaacgctagagtagatggaaatctaagaatcactttatgactagcttttgtagaaatgttttgagatagttaagaggtgaaactggtggagatgaagtctggagttgtgcattctatctttagatcgaggggaccagcacattagctggaatggctattatgaacctacatcaaaaactgccttgtacctcccttaaaggtgctgggattggattggcttaattgagcttaccttgtttatatgcctagtcagctgactccttttcttgggtgaggacatgcaaagtagaggaagtagaacctctgagggtagataacatgaaatacccttttcaggttttcaataatcatacatgtttagataaaaaattttcatatttattttcaacctttatggcctcggaatgtaatggcaactcatgtgcaacttatctatttacatttgaattgtactaggggatgaagagttatatggtatgatggtgcatatcaatgtccgccatattgacttgtattgaccgtaccatatagtaccgataggataccaatatggtactaaggtttggttcattatatgagctgaagtggtctgaactgagcggaaccacctcgtatcgcctaatactacttgaaattggggtgtgtaccatattgtactgatttgtatcatcctgtttcggttgatattgtgataaaaagggagaaaaaaaggggttggaagctatcttgctacagggcatgtaccgtcttgaccggaccatgctgaagcaatgatatctagtactaagattggggaccttggtgcatatattaaaatatcgaggctgtttaaacgaagtatatggtaactgtaaggatgattaccaatcggttgatacaaactgtatttttgatgattaagggatccaggtagtttaaacatgacatgaattctaaacatgagcactgctaatggattttgagaatgagcacacatttagatgtgcatagattaagtgaagctatggtaactgaccaatttaatcaaaagcttaacctgataaggaaggggtgaatagtgtatattaggcttaacaatgtcttatgtgtggcttggaccaagcacatggagggataactgagtcaaaactaattgaaatcagattaatagataaccaaggataattgaataaataactagacttgagggaatttgaactcatgaactctaatatatttgagctatgatactatgttaaataccaatttaatccaaaattttaacctgatagggaaagggtccataatgtataccagatttaaattatcaaactttgagtttttattaataaactaaactgcttattattttatcattgtatgtcctttgcagatcttgttgtagaagaatgaagcttttacatatcactgcatttatgttgcttgccccccaccccaaccaaaaaaaaaagaaaaattatgataatcttacaccagcatactgtctgttggtttcatctggcttagaaataaccattttcattctatttggatggaatcaggttaagtagatgttctaaggtccttgaatttctttcccatcgatctgtcttgatgtcattgacctttttcttgttgtttctgtctgtttctaacagattttcaagagcattaaaatgatgtcgagttcatctgagacgttggaaaagaatagtgaaaattctgagcagaatacacgggaggacagtgaatatgcaaggctggttgcaccaaatgagtcaagaacagttgacattaattctcaagaggcacttgagaaatcaaagtctaaatccttcatctggtggataaagcttttatcctgttgcttgcttctgatactacttgctttcacattcgtgaaatggggagtcccatttgcttttgaaaaggtagttccagcattagcccatgcgccccccgccacccacccctcttttttttttttttgagtttctgactttgttgtccctataaaatgtgaaagcaggttgctcatgtggccttttcttcttataaagaagttcagtagttgggctttaaaaataaatctcatatccaactttgatgagtgcatttgcatgcatttttacctgatctgaagcaaaccttgacaaaatttttgagctagagtgtgattgtataactctttgatcctgaatctatatcaggcaactgataaccaccggtttggatgtgattggttgttcaaggagatgcaacagtccatggaagctcctagcttctaatagttggtggaccctgccaagttaaagatctaatctggtcatcaaagaggattcttgttgaagagtggcaatagaatgagcaatttggtaaacattgcaggtgttctcttgagagatgaccacagaggtcattccagacctcatgggcagaatcagcatacataatgctactgtcagtatctgtgaagatgaatcaagaagccaagaataaaccatttgattgcaactttcccattgtgggaacagttggctgttagattgaagtttggagaggggattcatcaaaaaagaaaaaaaaaagaagaaaaaaagaaaaaactgtattgctttttggccatgagtaccattttcatggctcaaaaccaggtaactttagttgtcattagtaagtatttgagaaactagaacattcccaagactatttgaacggtggagggaaaatggggatatatctgaattcatacctatgataatcatatggagaagaagtcactcaagcagcagatttggaggtattagatggtgttgctgccgcgaaggatgagaaaagatgcagatcccggaggactaaatagagaagagaatagtcaggatcggctcctattccataattgaatgttgaatgtagtatgttttttgttgaggggtttgattttaaacaataagagaagaagagggtagatcatgagaattgcaggttatggacggtatacacacttaaaggattaaaagatatagatggtcgtgttactatataatcaaatcttctggctggtctctccatgtttattaagttttattactcagcatgttttttgagcatccagtacatgtagatgcagatgtgctatgtgcaaaatcactgctggttatttctttgatgttcatttctttaactttaaatagggcattggtcttgtctatgtttgtgtgcttgcaatttgtctgggtgcggaacttgtaattttttttaattttcctttttaagggtatcgcttccagctggtcatgatatggtatactctcatacataaaacaatatatggaaagcctgtgcaattatgtgatttcatgatgtactgtcgcatgaatattagaaattcagtacacataagaaatatatcagtattaccttcttgcaacctgtttttagtatctccaatatgcttcttcaatcctctcattcagcgaggtattgaaatttatctggcttttcctcttataggaggaaaaaagtaatgtcaatctcattttagtattattatctttttcttacatgtactagttcaattgaataattttgtaggttctcctgccaattatgcaatgggaagcaactgcctttggccggcctgttcttgcccttgtgctcattgcctccctagctttctttccagttgttttgatcccttctggtccctccatgtggctggcaggaatgatttttgggtatggtctcggttttgtgataatcatggtagggactacaattggcatggtattgccctatttgattggcttatttttccgtgaacgtatatatgtaagtcctctcagttccatatggctaccttcattctagtatcaaggatgtctctcaatgaacttctatatttctgtttcataatacagtcatggctgaagagatggcctcagcagacagctgttcttaggttggctggagaagggagctggttccgccagtttcgagttgtcgcactgtttagaatttcaccatttccttatacggtcttcaattatgctgtagtggtgacaaatatgagatttgggccttatttagttggttcaattgctgggatgattccagaagcttttatctacatctataggtcagtgagttttgcatgattggtagaatgaatatatgtttccaaaatagcatttgaagccaaaaaaaaacaaaaaaacaaactgtggaaggtttattgaatttcttgtcatttgatctaagggcaaagacaaacatgtaactaggatatccctctctttggggagctaatgcactcatgtcttcgaaccacattgatagttgatactgcttattaggtacctcgtttcactttttatgcatttgtctaatatcttcctttagcaacagggacctcgatattgaagtaagactgctataggctcaaccgttttccctcataatttacgccactacatgttttaaaataataatatgttgtatgatattgtgcattaaataacttgaacatcagaactggctaacctgcatctccgggcatgtttgatcaccaggccaggcttgtggtggattttgagtattttccttttaccaaggaaaattgtaatatttcttagcagctttattctcttttctaaaccaccttttcttttcatgttctggagcagtggacggctaataaggactttggcagacatgaaatatggcaattattccatgacacctgtggagatagtctacaatattgtatcctttgtcatagccattgtcataacaattgccttcactgtatatgcaaggcgagctctaaatgatctcaaaagggctgaaggcattggcagtgcaaatgccgaccaaggtggtgcttcggtggaactagaaaagcttccacaggaaagaccatggatatactcttcctcaagtgataatgtatgagggagaatttggtgaaaaaaggggggaaagaaagagaaaagagaaaggacatgttaaaatggcgatatgtgatgtctgattcaagccatatatttcttatagaaaagaagcctctgcatgtataggagaagaaaaattttaaaaagccagcagcaatcatcagcggaagttaggaatgggatggtgagccgtgacagaatttcgctcgctcgtgtattatattgcatccatgttttgtatatccagttttcagggagagaaaattaaacatttgccaattagcttgatgagattgttgtttgtattaaaagaattcaactttgttgatacatgaatccaccttgtgttaactgggtggtccttggtggaagttctgactcctgagtttgagccttaggtggtgcggccccgggactttattcccttgctcttaacagaaaaaaaataaagaagaagaaacaaaaagaagaaagagagactttgtttagaagaaaaaagaatgactttaggttctcattgtatgctggattggatagtaccacaagaaaaaacagtagcgctttcagtccaggtggtactttgagtttgtatacactctatttattcgcagaaaatggttatagattcagcttttgtcaagatcaggttaatcggctctggcctcgaacatattacggctttaagacgatatagagcaagccttactagtgacaacgtggactcgaaagcggttcatgcgctttgcccatcttgtccccttctggaacctcctagcagacgaagtgagacccaagtacatcgcttagaacactggatcctgtctcgttcagctccaagacaaaaccacctcccacatccatcagcaatgagaagcgtcacaaacagacgaatcaggttgccttcttgatgtcggtaagtctaacaaaacgttaatctttttttgtttgtacatcaaagcaatgaatcactagagagaacaattattaattttatattgcattatacgaaagacttggtgagacatgctgaagcggctggtgagtttagatggccaacataaacataagggtgagaaacctagtggatgattaaactcaaaaactgattgcgcataatactgcagattctgcaagcacatgttgattccaacatgaaactgaagtcatcgtcacttctgatgggtaacattcctggcctggtctggcaatgcacttgatcttacattgatggttcattgatgttcctgcaagggaagattctggtgaagctaaccccatatgatataactcctaaggctaagtactggaaagtaatatgtgctttccgagcaaatacgaaattacaccaggcaatattatcatccagcagtcgtatacatcggaataaactcttaagcacacagcttaagaattgatgtggccgtacaaaattagccgcattagtggcaccgtcggtgataaatgagacatagcatgtctcatattggaccacctcagcatgcgaagggctgcatgtgatagtagtgggaatagattttgcctttctatccaaatgccctttggagcattaagaacataggccaaaggttcaatagcaagtattttgatccaaactgaacatcaagaggagatcctataaaatgtgcatggaaaaaccaaggaacacaaagaaggcctctctctctctccctctcacacacacacacacacacacacacaaatgcatatgctgcttcaatattctgacttcaactgcacaatcacaatgtctctggttgtacgaggagctgcagctcaattgcaattggcaattgtagagacttgtgctgtttacaccaaaaatgaataaagatttcaactaacaacgataaaagatagatcgggcataacaacaaatactcagcctgattcttcatctcataatacatgacgtggaaaatcttgatataccacttgtcatctaagaagccatgtaagaggacattatcatctcccagggataatttttgtagaaattgagtatcaacagggagggaatacttgaaagatcaactgccttgcaactgtgggagttattcatggaagaagccaccagtaactactgttcaaaagtagcttgttgctggaaataattactttgtccacgtaaaagatgaaaaagagataatttgggaagctctttcttcaataacaatatatacggttatatatcaaggctcctttaccatgtatcttaggcatagcatgtaatgttaatccttttctctagagcaaaggttcaatctaccatagaagtttctttatgttcccaatcattttgcatagtgttttttcaatcattgtgttttctactctcttgtaatggatgaatcctaccatgtaaccctagttatgtatgacaatgatgattactactatgaggatgaaataattgttgtgaagcattaaaggatttcaagttcctaaaacaactaaattatctgaaagttaatgggagaaaatggaacacagactcatgcattcctaagcattcctaaaagaactacctcagtaattcatactattgctgagaaacttctagatcgcaagcaaatattaaccctttgatgccgaggcatggaaaagaatacgcaaaggtattgacaactccttacatcgaccaaggcatgcctggccaatttaaaagaatttctggtcagcgaaccttttattccaagtcatcaacaaaaatattcatccatgttgacttacgacttttgtcttaacaaaaatatacattttcactgattcatgagggcaaaatacacagtgatcccttcttcctcttctccatgaataaatcccatgttggtggatgcctttttaagcagcttttttaatctagctaactcccattttgtcatcagttcctatgaaaacttgggagatgagacttggcctcttgcatggctccttgaatggatgacaagtggcaaaacatgatttctccatatgtcatgcattaaaaaataattaagcaggtcaaacattggtcaacataatgtcatcaaccatttatcatagttagtgggtctctacttttattgttcagtgtagataagtcccaaacataaacttgattgatctctgtctttttttatttaaaaaaaaaatcatatcttatagcatttgtaattgtatttccatttggttgactcaggatttgtgccttggacattaatatatgtcctcgaatgaagtctggtccttttcctcctcccttatacacctaagttcaagcttcctctttactctaatgtttcaatccttcttacgagtggtcctcagggctccaatggcaaccctatctttcacaaagttagcttgataattcagcattgtagaataaacctggttctggttgtactatttcctcaaaagttagtacttcccataaaaatggccccaaaacctaggaaaatgctggcagatcaatgcatgtctttgagcgaattaatatagccggacatgattaggtaatagttgagcaagagctgacttttgaattatgtctttcttcttgctcaactgtatctctgataatttgaggagtattctctagattggtcaaaaaactagttcaataaccagtatctttttatcaatattatttgcagtgtaatgcttaaatttactttaggctgcatttgggtgcagatgtagatcatataaattcaaaaattttatatgctggtgcatattgtttttcacttaaaactaaaccctatttatttgaaatactcaccatatatcaagattttgtgtatttcagatgagagcttaacatttctttgcactagtttaagatgagttggggaatctctcttccacccaagcatgcatgggtgaattccaaggaaggcacaatatgaaatacttgcgcctgctaggaatttatgtggtagcaagcaaatcaactatccatttatctccaattttgtcacccacttgaccagctaaaatatgttagttgtggggaataacatacgaataagttgatggttagtaaggcacttcacaggacattatgcacactgctggacgcatgattagaaacattctcttctcctagctgtttggcaataaaatccagttgatttacacttgaagaatgaatagtaccaaataaaatttcatgcataatgttttttagaatcatgttgtgctaaaataaggtattatgacttgcaatcaaacatccaatactgcagtttgctgttttattcagttatttgtcacatggtggaacttcgataagctatataatatttcattagtttcaattattaattggagtccgctattgagcaagaagttatgatttggtttatagcatactgaactaggagagctctatcatttttagacttgttttcaagacccttattatacaccagtaacagcagggaactcaattcgatacagattgtagattccatcactatgattacttctctttcaaatcacctggcatgacattaaaacctcaaggttgatgctttccactacaacaaatttggctattagcgacggctaattattgtcgctaatagtcattttaattagcgacggcactccatcgctaattgatggtcggaaaaatcctagttggtattagcaatgacatgccttcgctaattggtggttgaaaaaattctagtcgctaattgcctttattagcgatggatattctagccgccactaatacgctaattgatggtcggaaaaatcctaatcgctaattgcctttattagcgacggatattctagccgtcactaataacaatattagtgacggcattagcgatggctaaagtccgtcgctatttattttgttatttttaaataaaattttaaaaaaaatttaaaaaattagcgacgactttgttatcgctaatgctgtcggtgatatttaattttattttttaaaaaatttataataatatttagttattagcgacggctaaagctgtccttaatgccatcggtaatagttaattttattttttaaaaaattataataatattttttaaaatctgttttaattaatcataatcaattatggttcctaacacctgttatagttaaaattcaaagataatatgacaatcacaaataaaaaactaattatattatattatattaaaaatataaattatataaatttacaagtagtatcaaaaaaaatataatacatcaaaacaaaagaaaatcagcctagatcctcctcctcgtccttttcctcatcctcctgctcctctccagcagctgatggatgagtcggatgtcccaaaatccccaaacgaagaaaataaaatattattaataagtttcaatacggagacgtatctttcgatatggaggcgtatctttcgatacactcctccgattttcgaacaaattatttctacacgtttcattcgataatacagaactatagacacccccgatccatcaattggatagttagattgaatttctagcccctagatcctcttctttgattcaagcctaaatatgtaaagcttctaaatatgaaaatttaaaacaagtaaaagagtttactaataagattacctgatatgatggctgggacaacgagcccagctagtcgcacagctgcagatcccgaagaatctccacaaatgtatcgcggacggcattctgaagctctgaggtcgctggctcagaagcctctgcatgacctccttcacatgcgcattgctccaagtctgggacgtcaaggcctatgagaacatcgaagagtattgagccgctggagggtcgaagctgtggccgaatcctatgacccgactcctactcacccctccgatgaccctaagccatccctcaagatcaagaaggggctgagtggatgggtcatcgccgtgccgcgcaacaacatactctgcataatccgcctatacagttaagacatacattagttctaatatacatatcagatcctgtaatgacttaataaatatagtttaaaattcttatcgcgatctgtcgcgatctagaatctaaataatcacaagttctcctagactggtgtgtggcctctcataactgtagctgacctggtggatgacctagctgccatatctacaataagtaaataataaaattaaattaattaaaatatatatataagaatttttacagttctaatgaagaattttggtatagatttcttaccaatctgtcgaccacaatatgtgtgccgaaggagctgcccgtgtgcctgatcgaagcctgctgggtggtccaattttgttggaccctctaccctctaccgtctcctggcgtactcctcaccgcttcactggtcgcagagggcctctcatacgtccgctcgcatccagtgattcctgtaggactttcaatccgatggtgattgagaattgaaatatttgatgacggactgtcgtaaactgtatagcccatctcaaaacctacgtgtggtcatctgctcgaagatcgaacggccagcctcctcatcctgagataagaatcagtagtactcctgcaagtagaaacaagcatgtattaataaatagaatacaaacccatcacgaattattaaattaaatacctttgacttatcagaaacattttccagactgcattacgagcccccgacggccaattggagaacttgttcatcagccccagcatcaatcgtcagatgatcccagtaatcacacaaggtatggagctctctgtaaatgtgctgcaaaattgattttgaacaataaatgttagactctacaatgactaaattttaaacatattcaataaagatataatacttacgatcggctctgaatgtggatgagctctttatcctcaggccgagtcaaaggtgccacgagccgggcgagtcctctaccatgcttctgcatctaagagccggtcgctggtgcgtgtgactgtggggtcactggtgaccccctgtcatccgaacctgagcgcaaaacatctaatataaaaaatattatatagttagtaaaggataaaataacataaatgagaatatctaaagtgttagagtttaccgcaggatgtgagaggtgcagaatcttgcgagctggctgcatgataactctctcctcgagagctctgtcctccgctggcacgactccggcctctagaagatatgatgtataatctctaaaaataaaaaataaatagattcaccaaattaattatacaattatagatgacaatgtaagatttaaaatgattcaaaaattatatacttagtaatactcatcggcctcttcagatatctagtacccttcggattcttctttcaattcttcctcttcttccacttcttactcttcttccagttcttcttcttcctcttcttgcttcttggataggattgttctttaaaacaaaatcagttggatctacctcctcatattgaccatcatgtacgagaattcctggagcatccaactctgtatctattgaagaccaatgaaatcctaatgtttcatcctcttgaaagcattctgataattggggctctcctttttcaaacgcataatgaacgactggagacttaaccttacagtccaccaatctttccttcttctcttccttgatggaaaaggagtatatacacttaagcagcttattgggttagcacaaaggggttattgacatatgcttttgatccatatttgatttcaataagcccatgtcgtggatcaaccttcatacaattatcaatatcaaaccatcggcacttaaacagaatgacactattatcacctaagggatagatcaacttgatcacttcttcgagaattccatagtagtcactcttcgcctctacccaccagcaatcttttatatacatattgctgttcattgtacttttatgttctctatattgctgcgtgtgaaatttgaaaccatttacattacaaccattataacatgtcacatactttgttagcctataacttaatgatcttagcttcctagatatggaatcgctgtctttcatgacctgcatattataaaaaaaataaattaaaaaaaataaattaaataaaaagacaatagtcgaaccaatttgcaaaattttgtgagcactgcatgaaaatttcttcctcgcttatcatcggattgtcccatcttagcatctcatcatattatctatacatgcataagataagtacatgataaatgattaaagagttaagattgtgatggatacttacttaatatatgggttgacctccgtgtagtttagcaaaacatgtctatgcctgtcgaagttcagtattagtcaatacccgacgaacttcatgcccaaatttacgagcaagataggcaaatattgagatctccacctttgatcccttactaccatcatcatgtcgatccacttgagtcagctttgtctgcacactaaagttaaagtagtatcgattgaaatttaaaattttttctattatataagccttcacaatagaatcttcgattcggaccttgtttttcattttttttgagactgtgcatatatctttcaaatggatacatctacctatactgcattggtccccccaccctaacttcatacgccagatgaatcacgagatgctccatggagtcgaagaagctaggagggaatatcttctccaacttgcatatgatctctacactgctggcctcaagactgaagatgtggtcgatggataattcggtagcacaaatatctctgaagaaaaggctaagcttggtcaaagaactctatatggagttgagaaagagatcacaccaagccgatggaagtaatcgttgcatgaagacatagcagtcatagctctttagcccatataatctgcaatctttgacattaacacaccgagctagattacttgcataaccatctgaaaatttaagacttttacaccattcacaaatgtccttcaactatttctttgttaagatataagatgcttgtggcttcagaaaattttcaagtgacacctcaaccagctctaactgaggacgcttgcatatgttcttcatatctgctcgagtcttaggattgtccttcatcttgcccttgacatccataatagtgtagaaaatattatcgaatatattcttctcaatatgcatgacgtcaagattatgacgaataaaattgatggaccagaattcgcagaagatacttcgcttcacccaattaagagttctaccaaaaactccgaggcttctgcttatcaaatagcatgccaaactggccatcgtccaattgggatacgctctgaaatatttccataccactaaggtgcggggggtgcatgatccttctctatcttattcttcctgaaactatcctgctgctttcgaaaaggatgatgcttggaaagaaattgacgatgacaatcgaactaacgggacttacatgctcaagctgaaatgattttgtattctccatgcaatagggacatgcaaacttcccatgagcactccatccttacaacatcccataagtaggaaaatcgctaatggtccacatcaatgtagtcttcattacaaaattctacttcttcgatgcatcaaaagtatgtatgctatcagaccataagaattttagctcattaacaagaagtcttaaatatacatcaatgcttctaccatgatatcgtggtccaagaatgactaatgtaaaaaagatgttatgctttttcatgcacatcccaggcgaaagattgtatggagtaataaagactgaccaacatgaatgaggggccgctgcatgactgaatggtgtaaagccatctgtagatagatctagtcggacattgcatgattcctgagcaaataaaggatggcaagcatcaaattgcttccatgcctcgctatccgacagatgactcatcatatcgaagtgcttgcaaattttttttttgtgctatctcatctgtctgacagtattcttggataaatagagcctccgaagcttaggagtgagcagaaagtatcgaagaaccatacatggtatgcccttctgatttttaccctctagcctcaacttaaatcggctttcaccacatacgtcacatgagctctttagttggttctctttgtagaaaagcatgcaatcattacagcatgcatcttctcgtatcccattgcctaactcttttaccattttctttgaagcatagaagctcccaacaagcttctcatccttagatagcatcttctttattattgctatcatcctattataacaattcactgtcatattaaactcaaccttcatattcaacaatcctgacacagctaataaaacagtgtgttttacatccagccacaatggttcacagcatatggtagaaatcgccgctgtcagcttttggattatcctccacatcccagttaaattcaggactagtcgcatccataaccatgtctaccattctatccatgtccctgtcctgctcgcttctaactcttgcaactttctcccacgtctccccatgcaggtactaatgcttgtagttggcataaatccactcttatacaaatggacaataattgtatctctatcaaacatttctctattgtcacatctgttacaagggcaacgagcccatccttgatataagagtactgcattttcaaaagcaaaatcacagaagtactctacaccctccctatattcagcaaaaaccattctgtcaactactcgacgatccatccaactatggtccatggcacactatctaaaaattctgcataaatataaacacaaagcaactgttaattaattattttatcatttaaaatggcttacatagtaaatacatcttatcatcaactaatatgtatagaaagtcctaacccattcaagaaatgtattaattctatagatcaattacaataattaaacgatacacaacaggggccgaaaaaaattttgacagtatttttctttagttctccccacatgactgaagatgtgtgggaagaactaaaggacacgactgaagatgtgcggggagaactaaagaaaaatactatccgaaatttcttttgaatccttgacatatcgtttgattactgtaatgacctataaaattacttgcatttttcaaactgtccatactagacaatcaattgaccaatatacataattctttcatccatacaaaatatataaatatacggatacagtagaatatgtacattaatcaaaagacggatctatgattccatgcaatgcaaatttttttaaaattaacaccaaattaattacttaaattaacatccaattataggataccgtagaatatgcactctgcccttgcgcgaggactggctaccctggacatcggctgggacccaaggcctgagcatgtagggcgtgccccgaccccatgtttgcaatgctgcccagcaccttccatcggcctaagcacacaaggcgcacgagggctggatgccttggacgctagttgggacccgaggtccgagcatgcagggcacggcctggctccatgttcgcaatgcatactgaccggcaccttccctcggtttgagcggggctggatatcttggacgccaactgggatctgaggctcgagcgggcagggcacgccccgactccgtgttcgcaatgctgcccggcaccttccttcgatccaagtgctctgcatgccgagacccaagtcccgtacttctaattaattaattaaatatctaactaattaattaaattaatatttaattaattaatttttaatacataaataaacttaattaacataatttaaataaaaaaataacttttagtgaccgcattagccatcgttaatactcacaatagaaggcggactggcgcatagagactgaagggcgagaaggacgactagggacgaaacactagagacgagggcgcaagaaggcagtgcgggtcggggcctcgaggttaggtcggcggggcagggccgcgagctgggggcagcagggcggggccgacgaggtcgggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactaataaccgtcggtaattaattaattaattataattatgatcgaatttttttaaattctcaacttattataattataatttttttatttttctccgaatatggtatgattttagaatttaaagcgcatctttaccgttcattatctaaataattatcgttaaagcaccgtcacaaaagaccgcctcgatccgatagccctagatatgttgatcattaaaattcaattttcacagccacaaacgactgcacgatgatctgatagatgagaccatcgatggatccgaaaacttacaacgatgatctcgatgatatttgtaacacactatctaaattttacttcaatcggacatcattatcatggtcaatttagcacaggatgatttgagccgttaaataaaaaacgaatgatcaaaagactaaatggtgtctgattataagataattttttagataaatgatctttgctactactttgatcgtttgtatggtggtgatcgtaaaattcaaatcgcgtatatatgaacgatcaaaaattctcttgatactcattcttaaagtcttttaagtaattatacttgtgcttttataagatctgcttaacatcgatggtttatatatatgtgcaatttgaattttatgatcaccattgtacaaacaatcaaagtagtagcaaagatcatttatctaaaaaatcatctaataatcggacgccatttggccttttgatcactcattttttatttaacgacgtaaatcatttcgtgctaaattgatcatgataatgatgtccgattaaagtaaaattttgatagtgtactacaaatattatcgagatcattattgtaaattttcggatctatcggtggtctctatctatcagatcatcatgcgatcattcatgaccgtcgaaatcaaattttattgatcgacatagctaggactaccgaattgagatggtcttttgtgatgatgctctaacgataattatttagataatgaacgatgaagataattcttaaccatcggtaataaatttaataaataaataaataaaaattttacgacggcaattccatcgctaatagtgccgtcgctaatgattttttaataaataattttttttattgtcgctaatattctttccaccgtcgctaataagtttagtaaataaaaaaaaaatttcttttatgttttgcgaagatgaattccgtcacttatgattattagcaatgacatattttgtcgctaataatcttttggccgtcgctaataagtttaataaataattttttttttgcgatgacaagatccgtcgctaatagtgccgtcactaatgataattagtaccgtcgctaataagtttaataaataattttcttcaataaatatttttttttacgacggcttatttttttgtcgcgatttttattgataaaaatggttattagagatgacaaaaacgttgtcgttaatagctgtcgataaaaatattattagcgatagagatattatcgtcggtaatgccatcgctaataaagattattaatgatggcaaaaacatcgtcgctaatggccattgctaataccttaatttcttatagtgttcaactgataaaatcaaatagaggactctcatgctggaagtgacacattagtaggcattcactggagaataaaaaaggcccaaaaagttgaaagcaagagtccaatggttgctacaaaacacatgcccatacaacatgaattaagtattacaactgaaatgtatggggaggcaccagaaaactacatatttttaaagtttctgccttgatcctcttccgttcaaggatcaaatttttttcctagatataaaagcattttatgttttatatttcttttacttttacaagaattaacaggaatcttattgttatacttctataatgtgatgaccttcacttttgcttgaaaggaaatgtgaccgacagatatgatgaaagtagcaaacctccataaggctatctttgtcatgacttaggacctcatccaagatctattcagtgcataaccaatatggaagtaaacacagacccacatgtgtcctagcatcctcgcctggttaagggtttaaatccgttcacatctaatcacgagcatcatgaccatcccgtggtcagctccaataggcttgtgatgtagtgtccctaattcatatgggctatgtgtcgggtctactttgatatcattttcacgacttagtatcttatccaaaaaaagctaaccaaaagatattatttagatttcttggtactatatagatatctaagatccaccaaatgcatagccaatatgggattaaatatatgtgcgcacagatcctcacaattctccccttcccagtctcgctccctttctctcctcctggcactctcttagctccttgttatattcgtacttcatattctttttccacacttttttacttctcagcctgtcaactgatctgttcccaaaaccaacattaagatcctgcataattagacttcccatcccttaatactctccatgaaaacccagactcaaaccagactctaaatccactagccataagccactaaaccataggttgggcctgataacctagtcacttgtccactctctgaactttcccgatgacctgctttgctttaacaaacttagccactatctttgccagataacctgaacctgaatttcctagatttcagctttttagatcgatcgtcatttccctagtactatttcgttttataaatatgattagaaaatcctgcaaagtattttgcaaccctagaaatccaatttaatgcactatcagaaccatgctttgccttactctaaaacccttaccctagaagatcaacttcaatggtggaaccaagagttttctcttgggtggccaacgtagtgactactaaaaatggaaaaagttgattgtaaagtctattgtttattgataaatttcaaagttagttttcctcctcccaagggagggaatcctatattgttttcataaattatgactctatagtgccaatggttaaattatgtacataaagaatatatagaaaaacaaagacaaaaaccacaaaagaacaggtgttagcaccagagtttaaaagaagcatatgcaagagtatctagatttactcacgctaaaaagtaaatttgatagattatgcaaaaggacaagtcaaattacctggaatatcatgcagaataacatgacctacatgtgctacaagtgttcaagattgctctctcacatgggctgttctttggcaatattgttgctcatttttataaaaacaaatgccactttctttatgtggaataccagaaaacacaggagtgggactataatatttgatagtgatccaattgcaacgacaactaagaggagctgacttgggacttaaaacaaaaaacaataaaaatgtcataaaaattcaaaacacaacaaggtgattaaaaaagaaggggaacaatgaaaataaatagaaacaagggtgaaaatcttcacctacttctttgatcgtataagaatgggtgcaagaggagagttgtaatgacatattgtaaataagttaaacatcttgcttcgatggaaaacttctctacttgagatcggaataaggggaaaacatcaggcttcgtttaattgtctgttaaagaagaaaaagaggatggacttgtaaggctgctgctttgttgattgttttccccaacaaatctatgtaagttggattgtccatcaatgcttgatcttagtgaaatttttgagataggaaaatgttctcggcatgttgatctaatctagcattcctgtgatgaatttgaaggagtatatctgatctagcacatacacaagtttttacacatcaagtatgcacaaagccatgcaaatgctaacccacaaaataagattcattgaattttcgtctttttctctctcttggcatttcattttcattggaattgggaaaggatgtaaacttctagtgcccatctcttaggagattcagaatacttggtgggtggtgttttctttcttttcagcttgtgctttttattttgtcttcacatttcaggctgatggctaacttttgcaccagcctacattttttttagatgaacaaacctcttattacttgcacaagcctataattacttagtgaaccctgtctagtgtcatttctagacatccatttgaccacatgtcattagaaatcttcaacgcctagttgtaaacagaagccttaaaatcacaaaaaccattgtccaagcctcatcaaattagggagcctctggaatacaaatgtcattaagtctaggaatgacaggataagattttatgaccagccatggcagtattcctaattttcaaccagttcatggaaagaactgtacagtatataccatttgacgagcatataccaagacgacacactacattgtccttttttagtgtgttaagtcttctggggatgataaccacctcaaattgcatcattttggctagaattggaccacttcaacagctgtgcctccatgcagtgactcacaatcctcaccgacctcaggcataattaatgatgccacaaataatttgggccatctagcttgtggaacatctaaaatgtaagcagccaagtgatcaccaccactggaaggatgtacatttgttctagccgctgtaaatgtttcaaatgtggtaccaacttgtggaactcatcattttgtaacctacactttcctaaacctatatatttactttgctaaaattcagtactgatcgcataatggatcaccgagaagtaggaaagtgcaacattgtaagacataaaagatcatatcgagaaatatatgatagtctgttttgacaagtctagaacccatccatcaaaaaataaatgagccaagaaaggcctatttttagatgattagtggggaggcagaggagaggaggggagaagagattagaaacacacaagatggggagaaaaggggggtgggtggggagcatattcagatttacacagggccacaggaaggatgatgtttgtatcactgaaaagggtgtttggtggcattggatagatatctaagaggaatgtctccttggctttgtaaactgtactacagagtgcagataagtagtcaaaaaggaagaaacgtcacaggaaatctaaagagaaaggaatgatgatgtacagaccggcatgaaaatctatcattgaaccacaaaaatagtaatggcatgggataagctgcgagataaagcaacaacaagttaagacgctaaagagagcattgaggtgaagaagtaaaagaccatttttattttaactaatatgattatggacccatgggaagggtcaatcaggatatttaaacagcatgagagatgaagtgagaagtacacaaaccatgaatctcactgaaatgggtgactgatggcacttaatggatatcaaagaagcatatcgcctttgaattttttggtgaggtgtaatcatagagtgttgttaagcaatcaaaagggaggaaatattaccaagtaagaataccaaggaaggccaaatgatgatgtccaaattccagaagtacaagaaactctgtcaacaacttacaccagaaaaagatgctattgactctggtcttgaccttgcatagcctcctaacatggcactaataaacttatgctttagaaggggtttggcaaagtatgctatctgagtattaaatatcatatcagcagtcaccagcactagaaaagaagataaatcagtatgatgattttctcaacatttatctggagatacacaaaccaaaataaatattcaccaaagtcaatcaattttatctctgtacttttattcagcaagaaaatatctctttgaagacagtcataacaacaattatctcaacaaacacatatgataatagttacatatattatgaagacagagaatgtagcctttgacaacaatgcctggtagagaagggtttgacaatgtcccagtataggccacatgaaatacaacttgtcaaaaaatgtttttatgatatcaattaatgtacattttttttaaattttaaatagaggtaacttttgaatctataataataggaagaggtcattcagaaaatctatataatataacataatttagagtaaattttaacccagggttcccaaataccaaataataaagcataagagaaataaacttctggaagaacaacttagattatcggaaaaagaaagaatcctcagaggtgtacagcaaggaccttcaatgaagggaggcgaaagaatcctcagaggtgtacagcaaggaccttcaatgaagggaggcgatctttgaagaagtaatccttcaggcagtagcagaatttacatgcataaaagatgggagagcatcatccatgttgctgcaatatgtatccaaaatacaatcagttggaaaagttgcaattaaaatcatatagttgataaacataagcattattcaagactttatctgtccataagaaaacagaaacattggcagatcacttggtaaaaaagtctcaacattttgttgacaggttcgccatgagaattcacattattagcccctcattgtacaccttgatttattcacattgtggtttactcccaaacacttcagtcatcacataccaaaagcagcataaggtctatcattcagaactttctacttctatcagctgctcttagatgcaacaaatctacaagttgagttgtcagttgtcatcttcacccaggctaacaaaataccagtttatcctaatgctggaatcaacataactgccaaattatacactcattcagactaacttttgtaaaaagcatatatgacagttgcgtctgcatcccttcttaaaacaaaatgatacatctaagagttatttcagaaacagagtgaaatattaccagtctttttggaggtgtaacagctttctgctatttggcctccaacatcaaacaataccagaagagaaggaaactgggggaaatgggaaaggacgaaattttagccacagtacgtccatttgtatccctaattttcttcatttcttcgcaaaaaacaatagaaagggggaaaaaaaagattgacgattaacaagaataaaagaaaattaaaaaaaaaaatctaataggttggaacatgaccactccggtataaaagggagaatatcatgaaaaatcggaagaaaactcaaagaataatattctatatatggaagaattttacctctcttacaacatgaaaaaaaaaaaaaaaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagagagaatttacaggtatcaatcagaactctctttctacaaagcaaacaaacggaaaaagaaaaaaaaaatatatatgcactctatccctctcaaaaaaagaacgactcacgaacatcgggagggccttgttcgacatccaatttctccacctcctatcactaaccagctctcaaagaaccacccaacaaatctgggagactggttccgaaacccaaacgatcaggaatcgccagagagagaatctcagatgatcaagatttgcatcacgaaacccaaaaatatcatatcctagaagaaaaagaagaaggaggtaactatacagaagaagcagaatacaatcctcatcaatttcaatttcaatccatgatcgaaatcaattccttatttgttgttgtctgggcggtggacattgcagtccgcggagtagaaatcgttcctctcgaggagagacctcacccagtcgtgataagaggcgggcttcttctggggatcttcgggccggagaggcgagccgggagggatcggaggggcgttgaagcataggatgcagcccgtggggacagcgtcgtaggccggcgccggcgttctcttcttgcgcctctcaccgtcgccgctgctccggtggcagagcttctcgaatttcttcacggggaagaggagcgcctgcttcgccttcctcttgtaagaagaagaagatcgtcgcttcccgttcctcctcgctctctcatcgtctgtaacaccaccgccgcataaggccaactcgttttccgccccatctccacctttttctctttcttctgtgggtggttctcctcgatcagacatataacgcccgccgctctatgcgctagtgccttatttatctatcagtcgaacagagttaataaatgaacaaaagaagaaaggaggaacctgcatagatggatggcaacatctaagaccctctctatctttctacggatagatcaacaagaggaagaagtgaaacatttacgatgagagaaaacgccgccctagaagatctcgttctctgcctatctatgtactcggaacaaacaaaacaatagcagcaatctgtgagagagatcacgccaagggggagaggttgcgggggtggatgaagaatttcccggttttgccggagaatcgggtggatgtgtgtgggtgaagaaagatggggaggagcatccgattccggttcctgcactcatcattcaggggcgtctctgtattttatagcgtatatgaatatatatgtctataaatcatttttaaaaggttacatcatcatttagttgcaaccggttcacattttgcccttagcaacaaagtaatggatcagttctttaccaaaatatataaaaaaaaaaaggaacagtggagttgtccgctcgccgcggcacccaacgccacaccctatccgcaaacaaagccgagtaaggctactaaatttaaaacccgagggaagctggaattttttttttaaataatatttttttaataaaatatttcaaatttacggatggttggaaagtattttccattccaccgtgccatgtaaaatcgtgaatataacccataatttcttaactatcttagtaggtgatatgacccacaatttcacgatcatcttgataggtgacatggtgccgttgaaatcatagatttaactcacgacttcaaccaaatttaaaattatgaattctatccataaatttttttttttaatgataagagatgcgcagccatgaagaagccatgcgggcatcggggtggtggtgcgagcaggggtaggggggaccgcgaggagaggggcaatgttgagccagagagagggttgagggactagagatggcaaaattaatctgacccgatgggtatacaccctacccgaacttgatcaaatccgaaaaatagggtttgacaaggtttggataaaactcgaaaattatagtacgggtatgggtaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttgtggcatacggtgctagaggtgggggcggcgggtggtggtgacaagcgctggaggggcgtggatcgcgagagaaaaggagaaacgatgaaaagaaaggaaatggtatcgtgggttgagtctatgatttcaaatttttttgatctacgtcggatgtacatgtggacttgaaattgtagattgaacctatgatttcagctgaggtggcactggaattatgggttgaacccacgatttatgtgacacagtaaaataaaaaataattttcaacccaccgtagtttgagaatattttattaaaaaatattatttaaaaaaaatgaaaaacttgacctggcttgtaccttttgtgtgaaagaaggatttccattccttcatgcgaatccaccatgagatcccatattgatcattttaaaatctgtgcaaatgatgaatgattgagtgtgaagtgccctgagatctatgtgatggatgattcaatgatggattcatgcaaaaaaaaaaaaaaaatctctcttttgaccttctatgctagatgggatgtatgcatccatccatccatacaaatcttagaacattccatattctatcatccattcatctgcacatatcttgaagtactatattatcaatctccatctagttgcacagctctcaaaggattctatcttttatcattcatcaatataaatagctctcaaagcatttcatcctctatcatccattcatctccacagatcttaaagtacttcatcatcaatcatttatttgtttgtataagtttcaaagcactccatcctccgtcatttatctacttgtacaaatctcaaagcattctatcctttgtcatccatccatctatatagatttcaaaacacttcattttttactatccatctatatggatctcaaagcactccatccttaatcattcatctgcttgcctagatctcaaagtgttccatcctctataatttgttagcttacacaaatctcaaaatactcttcctcacatagatcttaaagtactcaatcctctagcaactatctacctaaatagatctcaaaatacactattttttgttatccatctacctatatatatctcaaagtattcaatcctcgatcatccatccatttgcatagatctcaaagtgctccattctttactcttgcatatatctcaaaacactctatcttttatcatctatttaccttcatagatcttaagacactccatcttctatcattcatctgcttacacagttctcaaagtaatttattctttgtgatccatctacctcacagatctccaagcacttagtcccttattagtatccactagtacggatttcaaaatactacatccatgtgattccctttttctctcaactcatgccaaaacaagtcctttgctaaattaataagaagaacaattttgaaattttataaaagtttagttatcatattcatctgataatattttataatagagatagacagctgaggtatattgcaacaaatttaaagttttattgattaatttataatttttaaaattttgatgtcatgtaaataactcaaatttataggagtatttctataattttattttgttattattattattttgcgagggagtatgagtcacggggttcattagaagacccaataggggagattgaaatcaatcaaagaacatgtatcatcatcacttgcagaatcgtgaaccataaagcctgaagaaacatcaatagcatatgttgtggaggttatccaccatccgatccaacatctcctcttcggattacgatcgagtacttgccgttgagaaggcttcgaggatcggggaaagacctgaggaaccacaacaaagcaaccctacatcatcgacttcgatttttgcttgacctcctaacccgatatttaccgaccttgagggtaggatcctcccaacgatgaagagcatagtcctgcatacctatgcaagtgccaacctgaggcaggaccttggcttagcatcaaactcaaaagattgaactatttattcatatgggagatccttggaatctcccaatagaacatgggcatgattagcatctaacatccatgactaataattctgaccctagttccttgctccaagggcctgatagattgtagcctaccaaccgaagggattaggggccaaatatcctatcggatttcagtgtgatagcttatcatgccatctctatatgaagaggttacaaggggatccccagataagctcaatcccaaaggactcttctttgctcttgttctctcattttttttattgttcttaagctttagctgacttaagcattggaggatctccaccaaaaaaatcatgataattatggattgctcttgcagatttccttttgcactttgagcctcaaacggtgcccgaccccaatcatatccaaatccatctaaaatcttgcagtaatagcatgacgctagaggaaaggccattagttcgattgaagagaaaagaaagcatgacaaggatgagagtacacaactctgccgcctccctccgatgatcatctcgccatagccactgcaagaaaattgattattagcaatggccagatgccgtcgctaataatagacatgcaatcgttaatggtattagcgacacaagccgtcgctaaaaaatcatcggaagaaagctcgatgctgaaggtgtatattagtaatggcaaaaataccgttgctaataattagtagtagtgacggtaattagtgacagctttctgtcacttataatatttttttttaaatttaaattaaaattattttaaaaaaatattagtgatgattttttccgtctctaataagccatcgctaatagtttctttagtgatggctttatcgtcgcaacagctatcactaatgataagtttttttaaaaaaaaattagtaattatatttgttaagacctgttataatttaattaacaagtaattatatttattaaaattaattataattaaattaataagtaatatatatttatggatattataacaactaataattaactatcaccatcataaataaaaaattaatattatatattatattaaaattaaattatataaataatattgctcaaatatcaaatacaatacatcaaaactaaaaaaaaatcaatggagatcctcctccttctcctcctgctcttgtttgttctttacagcagtagatggatgagagtcagatgtttcagtatcttgtaatgaagaaaaataaaatattattaataattttagaactaaattaattaaaattataaaattaaagtaattgatgcatctcaagtctaaatctttatgaagaaatatattttgatatactatttcgattctcaaatagattatttctacatatttcattcgatgatatagaactatagatatctccagccagtactctatcagatggttaagttgaattttgaccccctaagtactccctctctcccgcttgaagtctaaaccggtgtgaagggatatatttcaatatactccttcaattctcgaatagattatttctatacatttcattcgatgatatggagctatagacacttcagacccattcattaaatagttagattgaattttgatctcttgggtacccctccctcccgcctgaaatctaaactggtatagagagatatatttcgatatactccttcgattctcgaacggattgttcgtacacatctcattcaatgatacggacgtatctatacctccatcccatctatcggatgggtagattgacttttgacccctagatctccttccgactcaagtctaactatttgaagcttctaaatataaaaatttaaaataaaaaaaaatttattaatactacttgatttatctactgtgatggcagtgacaatgagctcaactgatcgcacagatgtgagtctcgaagtatctcaacaatcatatcgcggacgacgtcccgaaagctttgaggtcactggcaaaaaaatctctatacgacctcctcgacatgtacatcatcctatgtctagatcgtcgaggattgagagaaaaacatcgaagatcagcaagttactggatggtcgaagctatacccgaaccctatgtcccagctcctactcactccaccggtggccctgagccatccttcaagcttcgaggtcaaggaggggctgagaggatgggtcctcactatgccgtgctacgacatactctacataatccacctatacagtttaaaaatttaataatactattatacatataaatatatataaaaatttaataaataatcttttaagttaccatgatccgtctggatctagaatctaagtaatcatcgatcttcttagactggtgtgtagcctcccacatctacagctactgtggtacataacctagctatcatgtctacaaaaaataataaaattaagttaataaaaatcaatatatgatcaactaaatataagattaatataagtttagaatttttatcaatatatctactataacatatgtgccaacggagtcgtcggtgtgcttaattggatcttatcagatgatccgattttgtcaaaccctttgctatctatcggagtactccttattgctccactagtcatagaggacctcctatacatcccctggagctttgtcctttggagctctctcctcggctagtgtggctccatcttttaggagtagttatcttgtaatctataaaataaaaataaatagatttattgattaattatacaattatgacaagtaatgtaataattgaaatgatgcaaggtaagtataaaaagcaaataaaataagtacaccacaaagataaaaatgactccatatgtcctgagattgactccaattattcaagagtcgacttcatctaccctgggttcaactcttgctacgtgctagtcttctccagtgtgtcagagttgactcctttatctttggagtcgactccttcctttctgggatcgactactcatcggtctcttcagatgtttggtatcctctggattcttattcagattcttcctcttcttcctcttctttttcttcttccacttcttcctcttctttctcttctttaccttcttgaataagattgccctttaaaacaaacttagtatgatctacctcctcatgttggctatcatgtaggagaatttctgaagcatccaacttgcatctattaaagactgataaactcctaatgtttcattcttctgaaagtattctgataaatggagctcttcttcttcttcaagctcataatgaacgactcaagacttaattttatatatagcccaccaatctttccttcctctctctcttaatggaaaagaagtataatacactggaacagcttgttgagctagcataaaggggtcgttgatatatgcttttaatccatatttgatttcaataaacccatactgtggatcaatcttcatataattattgttatcaaaccattgacacttaaatagaataatattattacctatggtcttagcttcctaggtatggatttgcccccttgtatgacctgcatattataaaaagaataaattgagagaaattaaaataaatgaaatgacaatggtcacttaccaactggtagaaccaatttgcaaagtttcatgagtgctgagtggatattaattcctcgcttatccttgggttgttccatctcagcatctcatcatactacctatacatacataagataagtacagaataataagtgattgaagagttgagattgtgatggagacttactcaatatatgggtcgacctcctcaaagtttagtaaagcatatgtcactacctattaaatttcagtatcagttaatatccaacaaacctcgtgtccagattcatgagcgggacagacaaatattgagatctccacctctgatccctcatgaccaccatcatcattttgacccatttgaatcagctttatccacacactaagattaaagtagtgtcgactgaaattagaaatttcttcaattatataagcctccacaatagaaccttcgattctgatcttatttttcactttcttcttgagactgtgcatgcatctttcaaatagagacatccaccagtactacattagtcccctgaccctagcttcatacatcagataaatcatgaggtgctccttagagtcgaaaaaactaagagagaatattttttccaacctgcatatagtctctacgctgctagcctcaagatcggagatgtagtcgatggatagtttggttgcacaactgtctctgaacaaaagactaagcttagttaaagaactccatatgtgattgggaaggagattatgccaagccaatgaaagtaatcgttgtataaagatatggcagtcatagctctttagcctatagatctacaatgtttgatattgacgcattgagctaaattacttacataactatctaaaaatttaagatttttatactattcatatacgtccttcaactgctctctcattaaggtgtaagatgctttcagtttcaaaaatttctctaaagacatatcaactagctctaatagagaatgcttgtatatgtttttcatatctactcgggtcttgggattatccctcatcttatctttggcatccataatagtataaaaaatattattgaacatatttctctcaatgtgtattatgtcaagattatgatgcatcaaattgattgaccagtacgataattttcagaagatgctgcggttcacctagttataagttctatcgaaccctcaagatttttgcttgtcaaatggtataccaaattggacttcgttcagttgggatatcctctgaaatactttcataccactgagtcgcaggggtgcttcaccctactctattttattcctctgaaactgtcccgctgctttcgaaaaggatgattctcagagagaaattgaggataacaatcaaaccagcagggcatatgaccatgctcaagttgaaatgcttttgtattctccatataatatggatatgctagcttcccatgagtgctctatcctgacagtatttcataagcagaaaaattgctaatgattcacatcaatgcaactttcattacaaaattctgcttctttgatacatcaaaagtacgtatgccttcgcactataaaaattttaactcatcaataagagaccttagatatacattaatgcttctaccaggatatcgtggtcttgaaatgactaatgtaagaaagatgttatattctttcatgcacatcccagatggcagattgtatgaagtaataaagactggccaaaatgaataagaagccactacatgactgaatgatataagtctatcagtagatagatccaatctgatattgcatgattcttgagtaaataaaggatgataagcatcaaatttctttcatgcctcactatccaacggatgagtcatcatatcggtacttgcaaatctcttctttgtgccatcttgtccatctagcaatacttttagacaagtagagcctctgaagtctaagagtaagaaaaagtatcgaagaatcttatatggtatgtccttttaattcctatcttctggtcttgacttaaatcaattttgaccgcatacgtcacatgagctcttcaattagtcctccttataaaaaagcatacaattattacgatatgcatctatcttttcgtatcccatgtctaatcttttctcaattttttttgaagcatataaactcctaacaagcttcttatctttcgatagtattttctttatgattgctactatcctattataatagttgatcgtcatattaaactagatcttcaagtttaacaactctgatacaactaataatatagtgcatattttatatcctgattatagtgatttatcagcatctctcagtatacgataaaaatcatcactgccagcttctagatcatcctccatatctcatttaaatttagaaccagcagcatccataaccatgtctaccattctatctgtgtccttgtccagctcatttctaacccttacaactgtctctcatatttctccatgcaagtatcaatgcttatagttgagcacaaattcactcctatataaatggacagtcattgtatccctatcaagtatttctctattgccatatctcttataagggcaataagtccgtccttgatgtaagagtgccgcatttctaaaagcataatcacataaatattctacaccttccttgtattcagtagaaatcatcttgtcaattacttgacggtccatgacacactacctaaggattttgcacatacaaatacaagataattgctaaatgattattttattatttcgaatggcttatatagaaattacatcttgccatcaactaataggtatagaaggtcttatctcgttcaaaaattatattaattctataaatcaagtacagtaatcaaatgatatacaataagaattaaaaaaaaaattgacagcatctttccttagttctcccccatatggcgtaagatgtgtgaagagaactaaagaaaaaatactgtctgaaatttttttcaaaccttcaccctatcatttgattactgtaatgacctataaaattaattgtatttctcaaattatccatactggacaatcaattgatcaatgtatataattctttcatctgtataagaatacataaatatatagatactgtagaatatatatattaattaaaagatggatctatggttctatgcaatgcaatccttttaaaatttttaaataaggagcttcaaagtatcgagcatcgttacaaatggggagggccaagacgtgcgtcccacacatgtagacttgggtgcaccagatgactagaccgtgctagcacaccagcatggcatctaggcaaattccatcctagagattccaaagtaccaagcaacattgtaaataaggctagaaatgaatcggactgggcctgaccacacctctgtctgagtctgatctaaaatttttttcgtactttagaccaggcttaggccctaaaatcttttaaaatatgagatccgagcccggctcaaacccaatcagatcggcccatatcatttgtaataggttggaagcaagctcatcagcacttgccgtccgagtcttaccgattatccccaagggatagatattctctatcggaagtacattgatcatcgaagaactcactagaagtacatttgtcatcgaagaactcactaagttgcttccaccaccatcgaagtagatgagcagggtagagtcggtccgacagtggcctgacctcgaactctattatcgaaggtaatggggctactctcatcagagagctctctggagtggttccaacctcttaagagcaccactagatgcgaggttttgtatggtagtagtgctcatccagatcttgtcagtgatcgagaatatactttttgtgcataaattaaatttaaatattataaatttaaataaatctaataaatctaaatttaaatatatatttaaagaggagagaatggcatgtggcgatggtgatggcgacgccgtcgctaatactcaccaagtggcgcaaagaagaagaggagacggcgtagagattggggcgtgggtctgatggtgcagtgggggaagaaggggggaggcgaggggagaaagggggaggcagggcacggtagtgggggaagaaggggggaggtcgggaagaagggggaggccaaggcaccaggatgagggctccgacaagtttccaacatcactgggggaagaaagggggaggtggggaagaagggggagggtgcgggctcgaggatggtcaattcggtgcggggatgtcagatccaaggaggggatgacagtgcagggatgggggctttgggggtccgacgggagcagaagggggaccagaggtgggggaagaagggagaggtgatagaaaatgaaaccaaacgattggggatgggagtaatttttagggcatagtattagtgatagctaatttgcatcgctaaagtcttcactaatactaattatttaaaattaaatttataatgatgcagaaaagatcatcgctaataagtcttcacccttataatgatggatttaatttccatcgtaataagtagttgataaatattactattagcgatggcttatttaccgtcgctattacactattttcttatagtgagctggagtagtgccatccgagagtctaccacaatgtaaccccaagctccagtcgatccacagccattacaggccctagtctaggaaatctaaatgctgatttgcatggtgtagtagctctagcaagcaacggagtagtctttgaaaaaataataccctacaagccaatcacatatgagatatgatgaaattttttttatattttatcttccaaacttatgtatttgacattgttaattaataaaattggcttttcgattcattatatgctgcatcttattattgttttaagattataatgaatcctataggtctggacaatgattttaggatcacaatgagatcacgtcaatgagatctaaatctttgatagtcttaacctaaaatattttcagtcattagttcattgagtcagagaccaatgataccgataagactggcacgtcctatgtatgctcagtggtgaggatggttgatcttataactacttgtgtagtgacactaatataaaaatatgggtgctcattagtgaatgagttcactgaattgacctacgagagaatatctaatggagtcttatttacatgtcagctgattgttctttagtgaaaattgtgcaagcgatcctttgacctgagatcaccatggtaccttatgtacatgaatccatattttggttcactttctaacttgattttttgatctttatgtagggtgttctggatgtagtgaagtgtgtatggagattgtgagtggtcaataaggaatcaatcactcctaataaagagagcgaacatcctatgtgatctcataggttgatgattctgaaaaattttggccaaagcaggatgataattagaaagaaatttttaatatatcatcaactgaattatcaccttctgattgaaagcaattggacttaatatgatttcatgcctacggctcgtttgggatattgtttgactgaaggattgaattacacagtaacttgccactgaaggatattttgataatttttatcaaattttatctcttctggatagtcataatattttactagacgttaatattgatttatgaacttattagaattaaaaaaatttaaatcaaaaattaattagaaagagttctagttaattgagatacttgagctgacctagtctgattggattagggttagatcaagagtttgtgtctactgctagttagatttgaaatctaatagatcacacactttgaaatttgatcttgatctaatttaattagaatttattataaattttaaaggttaatttgatatgctagcatattgtgttaacctaagtttccaattaagttaagtttaaagtatttaagcaaaactgaacctgttgcctttgacctgattggcttaggtctatttttattgaactcctacctaacttggaagagttttaagtatgaaaagactcctccatgccaccctagttttcatgccaaaataaatgccgccaccctcatttatgcattaagaagaggaagagtccttcttctttaaagactcttatctatcgctttattttccatcgattcctttaatgtcacatgccaaaattaaataaaaaaattataggatgcagaagagaaagagtcattctatatgaagcctcttttgtgctacttaattcatcagagaaacaatttttctatgtgagggaagtggagtgtcaagagttggcaccccttgggtctccttgacacctcttcattttctatttaaatggggtgcctcttatgggataagggttgagaattgataaaaattcaaagatcttggcatgtgataagggagaaaaaaatctataaaaaatcaaaagaaaagacaagaaaaaattaagtggaaaagatagaaagaagagaggtgagaaaaatagcaagtgaggtatgcttgtcctaagatttgattttttcatatgttggagtacaaaatcaaatcttagattatgagacttttggagagaattcttttggtgtgatcctagtggagaaattgaagacaatagtgcgttggtgtgatcattctttaagaaagaagctggcagtgttcttataaagaaacggctgtagtggtgcaccatttgggaaggatcttgaccatctttcatgtggatgaccattgaaaaacttctactttagagtctcatggagatcaccttcttaccatattatttatttgaggaagtataagtttctaactctttgcatgcttggatttttattttgttcgacatctacaaggtgattctagggtttgagttttgatttgacagttttaattgttaaaattttttatttatatattaaaatttttaaaattcttattctactacatgaccgaaatctaatagtcttgatccctaaagttgccacaccggatggctccctcttggaacagtcgccagtctcaccctgggagcccaaaatcgctccctagcataccctccactctgtcctcacctttggtccctacttgtcaccttcccatcatagcctaagggaggaagactgatggcgataatcctaatccttctcctccagtagggactccactccaaactactccccaccccctcaaaaattctctttaggaaaaagagctcgagtagaaggtctaagacattgagtgctatcttggcgaagtcccagaatgggagtaattgaaatgacgatggtcttagcttcatctctcggtccccattctctcacaatatcctgagggaatcgattctggatcgattcaagatgcctcaggtagagccatacaatgactcttcggatcccctcgatcattaggagggctataaagccctcatgatgcttcacggtattttagacactctcttttgctttggcttcctagctacccttaagaaattagcacgagcatgctattcgaaactccacccagaatccattcattcttttgaacagcttgcaagactgttccttgcccacttcagtaacaaccaagcccagatgaagaatatcgatagcctcttctccattcagcaggaagagagcgagtcgttgtgtgaccaggtggcacacttcaacacccccacacttaaattgtgcaacctcgatgagtcggtggttatgtcagcactcaagtgatgacttcagaatgagtacctcatcttctctcttgataaaatatttttgacagactatgccaacctatttgcatgcgctcgaaaatacacacaagaagaggaagcccgggccatgcggaagcaagctgaagggaagaagatccccaataagaagtgaggccaagaagagcctcatgtgggcttgatgggagaagggctctctcgaccatcgaagagcctcaggtcgaggagtcccctcagcacttcaacaactacaccccctcgtcaagatcttgataaaaattgaggcttcggagatatctttactgaccctaatcgataaaaaccccatcgatcaggaggagcaaggagaaatactattgcttctactataaccatggtcataactctgaagaatgtctctgactcaaggatgagattgaagtcctaatccatagagactatcttggaaagtatgtccgaccgtgtcaggcccgaccgtctgaggagctatctcaacatcagttcgatgaggagaacaatgacaaccgacccatggatttgctagggggtgacagaagatttgctagggggtagacagatagtgtgcaggaaactttgcttcccctccaatgaaaacatcctctactgagtctggcaccttttgattatatcaataaaaatatttttctttagactctattacaggttttctatcaaagtgaatgcatgaaacaatcgactgatattaactatcaagaatgacctagcatcataagaagcatacccaagacaaccaagtgcagcctcggtcttcggaggatgacggttgaaaaaaatccaatgtgggatattcaaaccctggtgacaaggttgaaaagcaccgaactcatgcagatatcgcgactgcagctaagactttcataattctaaccaacgaggctctggtcatgagaagaaatcctgactcaagttagaacctcaacagcaagacctcatcaggatcttgtcgaacatcttatagtgatcggattaagatgacaatagcgacttgggaaaattatcacggattgactggatgtcgacttcagataagatatcattaggatcttttcgaacatccctatagggatcagggtaagatgatgatggtaatttggcaaaattatcatggatcgattggatatcgacttcaaataagacctcatcaagatcttctcggacatctccatagggattgggttaagacaatgatggtgacttggtgaaattgctatgaaccgattggatattgacttcggatgagatttcatcaggatcttcccaaacattcccataggaactgggttgagatgacaatggtgactttgcaaaattgcatcggatcaattagatatcgacttcagacaagacctcatcaggatcttttcgaatatttccatagggatcaagttaagacaatgacggcaacttggcaaaattgtcatggatcaattggatatcaactttggacaagatcttattgggatcttcctgaacatccctgtagggatcgattaagacgatgacggtgacttggcaaaattgtcatggatcgactaggtatcaactttggacaagatctcatcagaatattttcgaacatccctatagggatcagattaagatgacgatggtgacttgataaaattatcataaatctactagatatcaacttcagacaagaccttatcgggatcttcccaaacatccccatagagatcaggttaagatggtgatggtgacttggcctcatcgaatgagtccaggttcactatcgacggtgttactcctaaccaacttcgaacaccgaggcctcaacttgtggtctgagccaaggaccccttccttatgagcagttaatcaaaactatgactaagttggttgagcaagcaaaccggtgtgggaaataggagtcatttaacacaagcatcaaaaaggtaacaaggaaatccattctactagaaaaagtccattacaagaaatttactatcaataaaaagggagaaaaaggcaaaattacaaataaggctagtcgaggtcattgtacgtgggttcggcagaatgttcagtggcctcccgggcagggcccctcacaatgttcttggcagcaaggccaggagctgggtcctcgctaggacagactggtccttgagcgaggcaggctcatcttcgtctgatgagaacacctcgacctaatcatcactatcttttgagtgaagatggctcaagtccaacttgggaaccatctgatccaagcgcctcttacaggcttcaaagccgtatatgtaggccattgagaatcatttggcaacctcatccttgaactctgtcaaagccttgaatttctcaaagcccttgagtttggcctcggtagcaaccttcattgtctcctcttagccttggacttgatgagctccacactatcttcggtagtcttgattgctgcttcctcgagctctaggacctcctcaagctcagccgccttctgacgaagtaccccgatggccccacgctcgatggccactaggccctctagggccccgaccttctccttgagctgccaggagcttggacctagcttaagtggcctcttccttagttgccccctcacatatttggtcgtttgcctcgcctcctcaatggcctgcctcgcttcctccatagccttcatacgggccttggatgccctaaacttttcttttagggagagcctcatccggttgaagttgagctggccctcactcaggatggttatgtcatgcactaattgcatggaagaggaaggattagcaactatggacaaaagatgaagacaattatgaacaacaaaggacttatgccgagtagaccagtgtaggaagcaccagcaacctcatccaagggatgagcctttctctccgactaatcagtcggcagcaaaatcatcttcaccaactgtcaagcgagctggtggttctaaagcacagagtcattgctttgcaccctccttactatggtgctgaactcccctttgctcctggaccagaaggggcccacctcataccttgtttgcctcctcaaagctaggaaagatggtggctatagggtagatcaaggtggagacgatgttcgcccatctattgttaggggaggggaagcttggccagttgatgggaatggtgactgagctaactctaaaatcatcggtgcgacagatcatggcggctcgaccaccactggttcatcctcaattttcatggggtcagcactcgacattcctacgaatagtgctaaggtcagagtgggggtaaaaatcctcgattgggtactcctcgacttcttccatgaagtctctctactagaggagcccatcttcctcttcaacaccagcttgatggatgaaaaggtcggcctcactgctacaaaactgaaggaagagcagtcaattcaagttctaacaatggtcaaggaaattctctgaaccaaaaaggatgtcgactgcatcctaagataatgatgggctaacaccaatgtcatagatattttgctcgggtagcagttcctttagctcaagcacctcggcaaatcgagtggactttgataatctttttcatccttaggaaggatagacttgtcctcattaggagacaagtagggatcatcccaaaccaagctaaacccccagggctgatctaaacacatgcaaaaaaaatggttcttccattcatgaactgaggaagggagcccaataatgttacatcctaatcaaggaaaaaagtaccaccatcctctcttatgaggatgcttcttcaggatgaataatgctttgaagggagaacaccttaggacaatactgagccagttataaagaatgaagaaaataatgatcatctgagcagagtttgaagtgatctgagttaaaaggatcttatagaagtcaaggacattattaataaaaggatggaaggatacttaccaaaaaaagttggaaggaaaggtgaagaccaatccgaagggattcctcttacaatgcgactctaccttttgaagctgcagtcacacggccatctcaaccctagactttgagccaaaattctaaagagataggggattgagaatgaaaccttctcaggtcatcctcagtaagacatgacttttcattacttgattttcaaaaatctccaaacctacatatgaggctacccatacatcgccatatgggggatgggcatttagatgaagggccagtttcgacggtggtccgagaggtgctctcaagcctggctcgaggaggcggtgactgagaattctgactgccatgaagattttcacccttgacctcatcatcattagaagacatgaagaagaagaagctattgaatgcaaaagacagaaaggatgaaaaaaagcagaaggggaaaccaaaccaaagaaaagataaagaacccaagcaaaagccgatggacaagcgagagaaatataatggaaggaggaggatcgattggagactacaattggagatcaccagcatcaaggaagatgatagtaacaaggactgtctttctattgaaagcaatgataggggaagagttggtgcaggaaagaaaaatatgacaaaagcaaaatgggaggaaaatgatagaaggcctacttacaccacctactaacagtcaagattcaagccccgtgccattagattttgacacctgacatgcattgaaaataccaaatcacatgattcttcatcgcaccaatcccagagcgagccgcataggctaatccacaagacatgatgtggacctaccaacatacgacacatgggcaatcacaatgggcccaaaagtgacttctatattttcctctgtgagccattatgatgcgatgccatgagttgcccattcctcataaatgtagtgagattcaagaagtgatgtgttactgatgccctaggattttcttcaacaagtgctaccgactaaatatctgggagagagaaggttgggtcggtgatcgaagaactagtttggtaattgactatttccttcatttgaagtaataaaatcacttcggacttgagagtggggaataagtattgtagaggttatccaccatccgactcaacatctccttcttagattatgatcaagtactcaccgatgaggaggctttgaggattagggagagacctgagaaaccaaagcaaagcaatgctacatcatcagcttcggcttctgtccgacctcctaacctagtatccactgacctcgagggtaggatcctcctaatgacgaagagcatagtctgacagacctatgcaagtgtcgatccgaggcaggaccttggctcaacatgaactcagaacatcagaccattcatctacatgggtgatccttggaatctctcaatagaacatgggcacgatcagcatctgacacacatgactaacaatcttgacctctgagttagtggatacgttcttaactccaacaacctgacaaatcatggcttaccaaccaaagagattaggagccaaatagcctaccaaattctagtgtgatagcttatcacactatctctatataaagaggtaacaaggagacccctaggtaagcttaattctaaaaaactcttctgtgctcttattctcctattcttttttctccattattctcaggctccaactgacttaatgttgggatttggtgcctcgaatttgatctatagaagaaaaattaaagatggaggagcttagaacgcagcgcatgatggtgcagaggcccagaggcatagcgtatgcaggctcacagtagggtgcggcctacaggatgcatggcccaggcatgggggcggcccagcacgagtgcgcaggcgcacgacccagcacagggaataggtgcgcgcgcgtggcccagcaggattttggtgcggtccatggtggaccgtgggagttgtcgtggtccatgcgactgtcatggactgatgcagtgtagggagaaaatatcgcagcttataactattctcttcacggtcgaatggctaaggagtgattcgggtgatgttttgcatgatcagagggttcagatggcttgcggtcatgatcaaatggacaagaatatttttaagtcctaatagaggttgtatttctatctgcaatgggttttggacgcttgaggggcagacgggccgaaggacagaggtaatgtcccatggaacaaagagtagttggctggagtcggtagtgagcacctaagaggcagaggagctataaagagagtcggagcagcgaccagagcctcaggtggggtcgaaagagggtcttcttggtttttttatgagagcttttataagagatgagaggtgagagcttcttattgaaagaaagaggtttgagagttgagagtgtatgatctcttgtaattattttctattatagtgaagctttgcatgccccatggagctaaaccttgatctaatctacgtatttgattctcttttatttcttctttctttttactgcaacaaatagtataagatctccaacaattagtatcagagtcaggttggcaccggagtatgcgatttatatcaaagccagatgataccaaagtcgtggttgcagcagtgttgatcaagattgaagaagatgaaagagtcaggctcaatcaaagtagagatcaattagtatgatgaaaaaagtaatttcttcctatagcaagcgagggtgaaggatgcgctcatccaacagggattaatcgatactctcttatgcgaggagaagctgactaccatgaaggtgaatgattggagacgtagtggtgagcatgatttatttgtacttgatggatgatgtagtgattcatgtgcttggtgagacttctccgacggtgatgtagatgaagcttgaatagatgtacatgatgaagtcactcactaatgctctcttcttctgaaagtagttctatcagttttggatgagcgagggatagagcgtgcaggagcatctcagcaacttttaaaagattttcactgatctccttagcattggtgagaaggttaaggagaagatcaggatgttagtcttacttcatcactttttttttcttttgagtctttaatgactgctcttcttgtgaaaaagagcgccattaggatggattacttctatactactgcagaatgaggttctcagattgaaaaatcggacttcgagttcagatggcgactcagctttggcaatgactggagatggtggtggcagaagatgaggtagcaaaggatcgcaatgtaaacgatccaagtccagatcgagagattcaagcaagatcagatgctaccaatgtgattagttggggtattgagttaaagattatccgcagctcagagatcagatgaagactactgtggcaatggtaagtagcaatatagaaggcagtgacgatgttcttctagtgtcagatgaggtatctacttctttcctttagtagattttaaattttgcatgtttgtatcatatatgttacaaagaggagctgtttaacatcttagaaagtagtgagggcactgttcacttatcggataaattgagttgtgagatcaaggacagtgggacggttagcttacaagcacatgatggaatagtgaagaagttggataagatccaatacgtacccagcttcaggaataatctaatttcatcgagcagactggattcaagcaatacagatgcagagctaatgatggaatcctgaaggtcatgtatggcagtaggattgtgatgaaagaaagaaattatggaggatactacctcttggtaaaaagcttagcatgagatagagctttaggagtcagtgggagccttgtgcgaggtagagttctaggagtaggtggatcgaacacgagacgggagactcagaaggatggcatgcaatatcgcaaggtgaagtttctattaccataagaggctatctcgagtagattgtaggtcaggaggatcacagcacataacagagatgggatcgagcggtctggctcgactttcatatttgtccattcatggtggtaggcttatgccctaggacatggggacgagatcatccagaagctctcaaagttagatggaggtcgaatatcgagtcgagatggagattgttgagatttggcatctcgaattcgatccataggagaaaaatcaaagacagaggagtttagaatgcagtgcacgatgatgcggaggcccagagatgtagtgcgcacaggcccgcagcagggcacggctcgcaagcttgtgcaggcccgcaggacgtgcggcctaggcatgggggtggcccagcactggctcgcaggtgcgcggcccaacgagtgctcgggagcaagggtgcgcgcgcatggcccagcaggattttggcacggttggaccatgggagctatcgcggtccatgcgatcgctgtggatcgacatggtgcagggagaaaatataaaggctcacagctattctctgtgtgatcggacgactgaggagcgattcgagcgatgttttgcatgatcagagggttcaggtggcttgcggtcatgatcaaatggccaagaatgtttgtaagtcctaatagaggttgtatgtctatttgtagtgggttttgggccctcgaggggcagataggccgagaggtagaggtaatgccccatggaatagagagtagtcatcgatagtgagtacttgagaggcagaggagctataaagagagccaagcagcagccagaacctcaggtggagttggtagaggatttttttggattttttatgaacgcttttgtaagggatgagaggtgagagtttcttgttgaaagagatagatttatgagagttgagagtgtgtgatctcctcttataattattttctttcatagtaaaattttgcatgttctgtggagataaatcttggtataatccacatatttgattgtgtcttttttatttcttctttttttctgctgcaataagtagtaccaaatctccaacactaacgagtgcggactactatagtaggttcctcttttacacttcgagcttcagacagcacccggccctagccgcatccacttctgtccagagtcttgcagcaacaacacactttatgatgactttgatgaagtaattgagtgatcgtggttttttctttggtaaaatagaacaagaacacttaaacaagacacctataggtcttgcatctgccatgattaaattggctagatctgaaggtagctcggaattttttagcttttcttactggctggtggaagcttgcttcctttgccaaacaatctatagtttggttcccttatctaagaatatggttgcaagagaaatgttgaaggcattgagtagtagcaatgatattatgaatggctgggtgtaatgaagaagactttccatttatccaattggttattgtagcagaatctctctccaggatcagatagtcaatctgctagttttcgatagcagcatgaagtccgtgccatactgtcatggcttctataattggaacagaattcaattgcaagggaactgaagcagataataatataaggccttgatagtccctgatgacaaccaattctagaacgattctgggttagagaactatcaaagttaatctttaagaaatccggttgtggggcctgaccaagagatgaaggtttgttgatgagaatcctcaaagagatgtggaatgcaacgccccaaattccagttccttttaattttctgctgttgttggctcgataccactcattgaacaattgctatgcaatgctgataatgtttttagagtctcaaaatcatgcactgcatgaattaagggcccacttcctaaatctgcttgcccatgatgggctcaattaagcaatccaacaagccctccatggcgtgttacagagttcttgacaactagcccatgaattggcccctaaagttgctcaaataaagatgataatggatcagatatgaatcagatcagctaatacctatatccatcttataattaaaaatctcacatccatacccatcttgcaccctctttgggttagagcggattagataaattagatggtgtggggtgggtagataaaatggttgggttgagttggataagaaaccccataatacctatcaatttcatatatatgtgcgtgtgtgcgtgtgcgtgcgcgcacgcatgtgtgtgtgtgaaattaagtaaacccaagcaacagtcttatcaatttatttagttgaggaaggatcatatggagtagcctggactctaaattttctttttacttagtttataattcccatctaattcactccttggcatttgacaaaaaaaatataaaaagggataagtgggctccaaccctataagttgcttttatttctagttggatcaaatatacgatgcaaaaaaaaaaaaaccaatttcatggtataagatttttagtcatgaataaaaacattttaataaatacaagctcaatttttcacaaactatttttatcaatataatttttaaaatatttaatgtatttggaaaaatatttcaaatcaagatatataaaccatccggtccctttcagcctttttgagcatggccatgatcattctattgtaagatttgaaagagactaatttttgaatataaaatatatgctggtgatcatcctgattggttagatttgacaagaactagctcgtggataaaaaatatgccatcgaccagcatatatcaatgattactcttctggttagatacgaaaaactagatcctaaattggcatgatcataagccgattagagaacaaacatcacaattgattaaacaatgcatattttaatatacaaaattcatttcatgcttgatatgatattttaagattgtttttttatgcagagtatatatgaaatttaatttaaacataaatataaatatacataaataatatgcatattttgaatttcaaatatttaggttattattcaaatgcagatacaaagataagtaatataacattttaaatcagcttatatggcatacatgataaaaatcctagaacagaggcacttacttgcataaggatttgtgtaggagtgtgtttaatcctacatcaactatatattgattgggtcttagatacatataccagactaagtaactcaaataacaccttttggttggttgtgctttctactaagattttacattgttataaatggtattagattgagcttagcgtatggtatatacagactagagaatattgccacacgagcttattttgattgaccacaagctcatcatagtatttgtgattgaatttatggtacttataagtagatttggatccttgagtgggggctgttaaggcttaataaagaaactatgtaaggatccatatggggatataccggctagatattagatatttatataaaattaaaaaattcaaataatatcttttggttgggatcctgatcgttacagtgagccatcataaaatctaaaaaggtctattaccaatttgcctcacagcatggagagtattgaaagctttaaaatcgagatctcatccatcaataatgattagacatcatataacaaaggttaagaaacattatgagtacctcttcaattaagtatcactgtatgactatttgtgagtgcgattgctgaagttgctgcaagactccgattcaatactgatgtgactaaggatggatatcgtttggagaccgaaatgctaaagagaaaatttgcaagagaagttcgctctccccgaagattcttcgtgggagattctgaaggaaagaaaaactgtttctctttggaaagctcaggttgcatctaaaaatttttctattaatctacatgaataaggatcaaatacttacttaattagcagtggaaccagagatcaaatctcaaataatctgatataaaccttcgtgaaggcctggatgtacagaccctctaattcgcatgcatgttagacaccgcaggaaagcaggatgaactctgatctttacaacccactcaaatgaaggagaagatgtgttcgtgtgacatctcacaccagtaagtgggatgcctaaggagggcccatgcccaagggagaaggggcggcaccaaaggggagaggctaaggagaagaagaagggcttctctcttctcacacttctctctctttctctcttctctcaatctgatttgtttgttatttttctatacatccataggtagagaccctctctatttataaatgaatcccataatctaataagtataggagttctaactcaaatatgatttgaatcagtccaatactcatgaaagaaggatttctatatgagataaaattgctatcacttatgacaaccactttgcacccactccctcacccacatgggatgccccaaaccagcaccatttcagatgttggtcagcccatataagagaaaaatctcagtgcaaataggatttctcatatctcatccaaaatggatcctattcgaatctaattcgaagctggttcgaaataattttaaaagactgttaatcccaaattctttaggacttttataccaaatctaacttgaatttttgaactcaattaagcttaattaatttagatctaatctgaaattaatcaacacttaaattcaatctttcatatgctccatggatcatagatcagaaactgttcatccccaagatcgaatctgaacctcatgtatagtgctagctagacatagtcaactcttcaatcctatttgactcataatttaattctcaatcaagttagcttatataatcaatcaaatcaagtactttcaaattagacatataaacatagaccaattcttttctattttgtctgacttgggtgtgtgactccataagttcaaacactaagctggtagcacaggagctaatttctgcactaatcgaaatcctatctagcaatgattttcaatgtttagatagatcgaattatcgtaaagaaatatttcaaaatccatacacatggttactgcataattcgtccttttgatcctgaatgctttaggatggtctcaagttaactgtcaatcaagattgtttcatccatattgtatttcaacctttcaaatctatctcatagattgtcctgatcaagactttgctaaattaaaatatagtgatacatcaactctaataattcggaggagtcaatcccatcttgatccacatacagactttgtaagtacttgactgttcccaatagccttccatcactgtatttaaaattcagatagtccgacaccaaagcacagtgagttacttacaagtcactatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcttaaatctgaaagatacttatacccatgtgcttcgcgagcaactcttgacagcagaatgctcagcaggtgagtcattagttcagtgacaatgtactcctacatctcatctgtatgccatactagtatcaccacactcttttattaagagaacaaccaatccatatgacacacaatgacttccactcgataaacatcatcatcctgtaatgatgtatcatttgatcacaaatatgtttaagaactatacgataaatcctctctttatcgtacactaacatagttctaaggatttcattatagcataagagttcaagaaagatgttactttatgatgaaaaatatcagaataatttttattcaataattaatattcatatacaaaaaaaatttaatcgtcatccgattaattttaggatataattttcaacaactcccattttgactaaagctaatcaggacagtatcttatacccatcttttatttgaagtcatcgaactctttgatcttgagagctttagtgaagggatcggctaagttctcttttccatcgatcttctgaagtttgatatcacctcggttcacgatctctcacaccaggtgatagcggcgcagaacatgcttggtgtgatggtgtgactttgattcttctgtctaagctatggcactgaagctgtcacagtatagcagaatagagccatcaatagaagatgtaactcctagctcgtgatcaatttttgcaaccataccatcttctttgcagcatccaatgtagcaatgtattctgcttcgcatactgaatcggctgcagtatgttgcttgaaactcttctaacaaatagctcctccattcatgataaatacataatccgatacgcttctactgtcatcacaatctgactgaaaactaaaatcagtatatcccacaagttttaagtcagtgtctccatagataagccattggtctttagtatttctcaaatacttaagaattgctttcacaatctttcaatgcttctcatccagatcagaatggtacctactcactatccctagtgaataggccatatccgacctcgtatatgtcatagcgtacatgatagatcccactaccgaagcatatggtattctactcatgcgctctctctccttaggagttgtcggatattcttttttggaaagagtaattttatggtctattaaaaaatagtcttttttaaaattatccatattgaaccgcttcaacaaggtatcaatgtacgtggattgggacaatctaagcaacattctagatctattcctatagatcttcatcccaagaatgtaagatgctttttttaagtccttcatggagaattatgatgataaccacagcttcatactctgcaaagtcgggatgtcattttctagtaatagtacgtcatccatgtacagcacaagaaagatgactatagaatcaaaaatttacttgtagatgcaaggctcttctccgttcctaacgaagtcatacattttggtcaccttatcaaaatgcatgttccaactcctagaagcttgcttaagtccataaatagatatttttagcttgtacacttttgactcatctgtagatctgaacccttcagattgtatcacatacacctcttctttcagcttttcattaaggaaagcgattttgacatccatctgctagatctcataatctaagtgtgtagtgatagcaagcataattcagatggacttgagtattgccacaggagagaacatcttgttatagtcaatactataatgctgacggtatcctttgataattagacgagctttataggtctctacctttctatctgctcctctttttctcttaaaaatttatttacatcctatgaattttatctcttcagatggattaactagtgtccatacaccattgatctctatggactccatcttagattttatagtctcaagctatttctgagagtcgggcctttacatggcctccatataggtgatcgaatcctcatcattctcatcaagtttaatgagaacaccatcctggatcagaaaatcgtagtatctatccggttgatgcggtactctatcggatcttcttaatggtacttctactggctccaaatttgattcatcaatcaaattcaattctatatgtgttggtccttccaccttataaacttcatcaagtttaattttacaggcattagctccatcaagaaacttctttttcaaaaagattgtccgactactgacaaatatcttttattctacagtgaggtaaaaatagtatcctttaattttctttgggtaccctacgaacaaacatctatcggatttcgatcaaagcttatctgttcttaaatacttgacataagctagatacccccagatcctaaggtgtgagagcaccagcttacgcccagtatatatctcatatggagttttattgacagacttgctgggcaccttattaaaaatgaagcaagcagtttttagagcatatctccaaaaggtgattggcagactcataaagcccatcatagattaaactatgtctaaaaagattcaatttttcttctccaatacgccattatattgtggtgtttcaggaggggtccactgtaagagaatttcattctcttctacatatatcaggagctcactggtgacatattcacctcctcagctcgaacgaagggtcttaatactctttctagtttgtttctctacttcagcatggaatcgtttaaacatttcaaataattttgacttatacttcataagacagacaaattcatacctcgataggtcatctgtaaatgtaatgaagtagtagtatcctcctctagcacttatgttcataggtccgcatacatcagtatgtattagacctaggacatcactgtctctttcaccttttttcttaaaaggtgacttagtcatcttactaagttggtaggattcataggtaggtaatgattcacaatcatctatttcaaagatacgttctttgatcaacctgtcaatgctactcttgttcacatgacgaagcctacaatgccaaaggtaggattcactgatattatctaacttaaggtatttattggctgtatatattatactaacaggccatgatattatgtatatattatattttaattatccacgtataatgacagtattattcataatgatatcacaaaaatcatcttttattataaacttgtaattaagtttgaccaaaaggcctacagagatgacattcatcaaaaaagagggacaataatgataattatctaacatgatactactagactcgaagataagctgcaaggtttccaaggtcaaaattggaacaagactttcatctccaacgttaaggaaccgctcgtcctctcaaaactatctacttacctgtagtccctgcaatgaattgcatatattaataagactttcagtatccaatatctaggtagaagtatcacaaatagagaaattacaagaagttatcatataagtatcttgtgaagcaatcgattgctcctttctcttagttttagacctgtttgggtcaaggatagctatataagcaagatgattctttttttaatgacctagcttcttacagaagaagtactctacttggctcttgtcaacttttgataatttgctctgcttaggatcggtggcacgagatttctgtaccttttttttctttcctctcctagaggatcaatgccctgcaaatgaacctcccactaaattcactggctccttctggagctggtgatccttctcaaaagtctgcagtaactctagcaaattatggtagttcactgcaggcttcgtcattttataatgactgagaaaggataggtaggattttgatagcgaattgaagagatcatccttgcctaactgttcatgtaacggaaagccaaatttactaaggcattcaatctactcaatcatatataatatatgatcgatgattgaagccctctctcgcacacgggcattgaatactgcgtaggaggttttatatctctctgcatcctcaggggtgccgaaggactcgttcaatatttgaatgagctcttctggctttacatcctcgaacttacgattaagttcgtcgttcatagctaccttcatcacacaatgcataatcatgcggttattaagccacttcatataagtatctctcacggtacgaggagcattggctgcaagttttttggatgcctcatccgtaaggacatatacaatcctcttgtactctaagacgatcttcaactttcgataccagctgtcgaagttgggtccaataagcttgtcgctgtccaacagcgtacgaagggatagtgtgttggccataactgaaaaaaaaattaatctattagtatatgaattatttttaatcccaaagatatggactttagtctaaagatttttttactatttttacgaattggtagcctctacctccaactcgaggaattatgctaattccttagtgggtactagatccacatggactacattcgggtccaagtgtggctcggtcaatcctagtgcattcatgggtaggttcataatcaattattttttcaaataatttttagtaattggattttaccccaagcatcccttcagtaggcgtgtggcgccttcactgaaaattttgattaagtccaaccattaacatgacacaccaagtgcatccaacaaatagatattcagaccttagttggttcggccaacctaagcattgatttgaaggtacatcatgatggtcatatgatgaatgataattccaatacgtaatagatactaggcatgtggtgcctccaatgcctatttaaaatattggactcattatcatacatcttaataggaggctatgaccaagttatctcatgactttatcactttatggacctaataatttagaagatttgatttcattgacttgagaataagagaagaagataacctgcaaactgcaaattctcccactgacttcattaagtcatgcaaaggattagacacaagttggtctaaagatatgtaaatcagtcacactgattcaccttaatggcatagatctgtataaatcgactagtgatctaatcaaaatataatctactatgttggtcagataaatgagatcagtgggagggatgtgtccttaactcaccgtagatgcatctagatgaatagctcccaattaaaaatcacttaatcaaatctgtcaaaattaccttagacaccaactggttaatgagttttgatttggttcaccagaagattcgggctcaaccatggagccatgatcatgatccatttattagggtcaaatacatgaacttgatcaaacttcaactattgagattgatttagagaaatactgacctaatccaattcaacacttgattagatttaatcaatttttttacttgatccatatatgtttttaatcctaggtctagcctattagaaggatctgattcatgctaaccctttacccatcattttatgtagtatcttaatgatcttcaattccaaatctagatcattcaaagcttaattcataattaattgtatgaaatatgtgtttcagtctgtagaactattctacaagaatttcaggtgaaccatatcatatgtttcaatccataaaaataaatttttataatatgtttaacaattaaacatacataggtatgatctaaacttcatacatacatctcatgcatcatgataacttttagattaataccgattacatcttatgtaatatgcaattcagatctaaaataattttatatttgaattttatcctattataataaattataaattattttagatctaatctaaatatatttatgatcaaaataatatataaaaatctattcactttttttcttcctaaaattagatcataatgacacccttacacatcataagagaacccatcgaataggcaaaagagagattaatctcttcaaacttttatgatcaaacgatctgataatctcatcaatctgagtactagactattaagatctaaaatctaattttatatataattacatcaatatataattattgataaaataattttatgtcatgaacatattcttgatcttatcaattatgttctttatctaatctaattagatttgatgtatcatatatattatattagatctaaaatatatcttatactgattataaaatattaattttagatttaatattatataaaaaattaattagatgcaaatatgaatgcacaaagaataaatttttaataaaatctattttcgtacagtgctgaatttcaatagaatttagatctaaatatctatcgaaatgaatctaatttagatataaaataaatctcacttcataatgaaaatagtaatattaaaattctattaaaataaatttaaattagattttaatttatgttgttattccatcaaaaattcaatgaccgcagaattctattataacaaacttctaacaaccttaatcaataattgattaggctcatctaatccaatcaaagttagatcaaaaaaaatttatacaaatagattcaaatcagatttaatatctcataaaaaatctcagttacatcttatgtaattaatctcaaaaaaattaattatacatgtatatatttcagacctgctctgataccaattaaagggaaggaaaactatttctcttcagaaggcccagattgcatctaattttttttattaatctatataaataaagatcaaatttttacctaattagtaataaaatcaaagattaaattttaaataatctgatataaaccttcacggaggtctggatgtacagagcctctacttcacatgcacgtccgatgccgcaggaaagcaagatgaacttcgatctttgcaatctaatcaaatgaaggaggagatatattggtgtgacacctcacactagcaggtggaatgcccaaggagggcccacgcccaaggaagaaggggcggcaccaaaggagagaggctaaggaaaagaagaagggcttctctcttctcacacttctctctctctttctctcttctctcaatctgatttatttgctattttttatgcatctataggtagagatcctctctatttataaataaattttatgacccaataagtataggagttctaacttaaatctgatttgaatcagtccatgaaataagaattgctacatgagatagaattgtcatcactcatgacaattactttgcacctactccctcacccacatgggatgccccaaaccagcaccattttaggtgttggttggtccatatgagaggagaatctcaatgcaaataaaatttttcatatctcatcccaaatggatccgatttgaatccaattcgaagcaggttcgaaataattttgaaaggctattaatcacaaactctttagaacttttgtaccaagtctaacttaaatttttagattcaattaaatataattaatttagatctaatctaaaattaatcgatacttaaattcaatctttcatatgctccattgatcatagatcagaaactgttcatccccaggatcaaacctgaatatcatgtgtagtgctagctagacatagtcaactcttcaattctatttgacccataatttaatttttcaatcaagttagcttatatgcttaatcaaatcaagtactttcaaattggacatataaacataggtcaatttctttctattttgtctgacttatgtgcgtgactccataggttccaacactaagtcggtaacataagaatcaatttttgtactaatcgagataccatctagcaataatttttgatatccagatagatcaaannnnnnnnnnnnnnnnnnnnagattgcttcatttatattatatttcaacctttcaaatccatctcatggattatcctagctaaaattttgctaaattaaaatacagtaatatatgaactctaataattcagaggagtcaatcctatcttgatccacatacagacttcataagtatttgactgtatttagtagccttccgtcactatattagaaattcagatagtccggcaccaaagcatacttatatccatgtgcttcacgagcagctcttgacagcaaaatactcagtagatgagtcacatattcagtgacgatgtactcctaaatctcatctgtatgccatatcagtatcaccacactctttggttaagaagacaaccaatctatatggcacacaacgacctctactcgataaacgacatcatcttgtaatgacgtatcatttgatcgcgaacatatttaagaactatacgataaatcttttttttatcatgcactaacatagttttaaggactttattatagcacaagagttcaagaaagatgttactttgtaatgaaaaatatcagaataatttttattcaataatcaataatttatatacaaagagaaattcaatcatcacacgattaattttagaacataatttccaacagactcttcgatgcttaaatcaattagagttttagaatagtagaggaaagagagtgtgaaagggagaggatgtgagagcacactaggcattctctagaattgagtttacctaagagtcttacctctatatgtagaggtggagctgtatgttgtcatgctaaaacatggtaagccgttcagtcctaattttttagactgttaggcctcaatccgataggttgttaggactggagattcacccactaatctgtgcaccaagattgttagtcacggatcgaacattccaaggatctcccaaatggttgagtagtccaatgtttcaagattggtgctaagccaaggttctatcttgaattagcacccatgcaggttgttggactacattcgtcatcatcgataagatcacgaccttagggttggtaagtgtttgattaggtcagacagaagtcaatgatgtaaagctgcttcactttggttttaggagtccttcggtatctgatgttggtccatcggcaagtgctcgactgtaatctgacaaggggatgtcggatcggatggataacccctataacacttgtccctcactttcaagcccaaagtgattttattgtttttgatgaagagagtagctgatcactatactagacttcaatcaatgacccaaccttctctctagaagtttaattgccattatttagtggagaaactcttggggcatcattaatatgctgcttcataaatcttgtcacatttatgagggctgaatggcttgaagtatggtgccacaattattttaaaaaaaggagatctgaaaatcatttttaggcccatcgaggtccaccacatgttgtatgcttttagatcccatgtcgcaccccgtcgattaccctatgtggcttaatttggggatgatgcaatgaagagttacatgattgcatggttctgatgggtgccacatgtcaaaatttagcagtgcgaggcttgaatctcgaccattagtgagtggtataaatagatcttcctcatattgctctccttctattttgctcctatcatcatatccttgcttcttgcactagttgtccctctcttccatcacagttgatcgaaggagggctttttgtcattaccatcttcctcagcattggtgacctgcataccgcaatctccagttggtccatctttttcattttgtttttcttgcttctttgtcgactaccactcacatccttttcctttttcttagttcaatttcctctttctctttctcgtctcttcaatttttttttgcgtccagtagcttcttcctctatatgtcttctgatagtagtgaggctggggtgaaagccttcatggtgatcggagttcttggtcgccgcctccccaggccgagctgagagtacctcttgaactaccacctaggctggctcttcattcgaatgtcgatcccttagaccatgatgtacaagtagccccatatgcaggtttagagatttctggagatcaagcaacaaggagtagtatcttattaaggatgatctaaaaatgtttcatttctcaatttttcatcttctcgatgaaggaaaaattgcctttttcctgtgtaggatctttcagatttcatcaaatctgggacggaataaattttaaatttttatcctatgctattttagatctaatgtctattagatctaattttattatctgatattttaatttcaaaattaaatctaaaagtatgagaaacatagacatacctcaagggtaatctaattatcctgtagatgatcgcagtactgcttgaggttctgatgtagccacgcaagcacctggcctctaccagtatccactcaggtaggatctggaacatcttcttctcatgattctatgctccaaaaatcagatctaaatctgattagaaagatcttcaaaagtcttcctaaagttggagcagtagcttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttttaactcttgaaaatatgaattaacattctcactaactcaaaggatgtatcacagacacaatgtacacaatgtgatagaagaataacccttttatttatttatagtcaaaattataattttgttcttagatttgtacagaaatgtgtcagccgatctggcatctagggcacacatctaacactcgggtcaaagaatgattttaggatgatcgagcaatgaggagtcatgtctgatgccctggagggtcaagtcacattgtacgaggagtctcttcagatcgatctttgatttctactctatcccttcatctataatatttttgacttctataaggtcctccttactcagatcaccctgaactctacttgcatggtcgttatttttatcattctttgtaactagctcggtatcatcttgaggtattccctcttcatagcattgttcattttgaagaagcaccctcatgagaagggatggtgataactttttcctctgttagagtgcaagttcatcactagtctcccttccttggtcaactgttggaaaagccatttcttcttcatgtcttcggattgaccttgggggtttagcttggtctagggcaatcctcacttgtctcctaataaagataaatttttatccttcttgaggatgagaaggactatcaaaatctgcttaatgtcgaggtgctcgagctaaaggagctactaaccgagcagaatctttatgatatctgcattggtccgacattgcctcgggatacgatcacatcttttcttatttggaaaactttcttgattacttgtcagaacttgagttaaccactctctctatgattttatagcaataaggccaacactttcatccatcaagtcggctctgaagaggaagacgggttcctcaagtgaagaattttcattgaagaaatcaagtacttagccgagaattcctacccccgccccgatgttgtccataggaatgtcaagtgccgaccctatggagatcgatgatgagccactggtggttgagccattgaggtccgttgtgccgatgacttcagagtcagctcgaactccatccccactagctagtcaaacttcatcgtctccaatgagaaatgggtgaaagttgttcccacctccccctacctcacagctagccatctcccatgataccgagcatgtcagtgaggtctgaaatgggcccttcctcatctgagagtgaaagatgatttatcactatagcaaggagagtacagaggaatgattccacacttcagaaccaccaactcatctaggagttggtgaagatgactttgctgttggttgattgatcagagaggagggcctatccctttgacgagattattggtgcttcttgtgccaacctcctcagggtgagtatttcatctcttgtgcttgccttcgacttttaatagtaatcactaactttgctttttctatatagttggtgcatgacatcactgtcctgaatgagggtttggttggtttcaactgagcaaaacttttgctagagataaaatttggggcattcgaggcccatgcgaaagctatggaggaagcgaggtaggctgtcgaggaggtgaggtgggccatcaaagaggcaaaaagggcagttgaggaagaggcttcccgagccaggcgcaatctccagagagctttatagaaagtcagggccctgaaaggcctaatggccatcaagtgtggtgccactggggtgcttcatcagaaggtaattgaactcgaggaggccctggagctcgaagaagcagtggtcagagttaccaggatagggtggggcttatcaaggccaaaaccaaagaggagaaggtgaaggtcatcaccgaggccaaattcaagggcatcgaaaaattcatgactttgcagagcttaagaatgaggtcgttgagggcttcatggtggcctatctgtacgatttcaaagcctataagttgcacttgggttgaatggatcccacgttagacttgagccatcttcaccccaaagttagtgatgacgagggtggggcattctcgtcggatgaagatgcctacctcgatcgaggaccaagctcctggccctactattgagaatgccatggggggcacttcaaaggagaccgtcaatcatactatcgagcctatgcctgagaactcgactaactttatttgtgtttttttttctctttttcattgacagcaaacttcttgtaatagattttttctaatgaaatgaatttcctcttgttatcttttgatgcttgtattgagtgactccagttttcaacatcgatcgcttgcctggctagcttagtcatatctttggttaactactcataaggtaggggttgttggcctggtccatggtttgaacctcagtatttggagttggtctagagttatacaattgatagtcgattcgaagtcatttgatggcaacatttttgtcaatcgccatcattgtcttaacctgattccttaagagatgtttgggaagatctcgatgagatctcattcaaagtcgatgagaagttgatccatgataatttttgccaaatctccatcatcatcttaatccgttccctcaagagatgtttggaaagatcctaatgaggtcttatccgaagtcgatgcgaagtcgatccgtggtaatttttgccagatcaccattgccatcttaacccaatccctagggggatgtctaggaagattccaatgagatctcatctgaagtcgatgccatgtcaatccatggtaatgtttgccaaattgccatcatcatcttaacccgatccttagagggatgtccaaaaagatcctaatgaagtcgcagtcgaaactgatgccaagtcgatctgtggtaatttttgtcaagtcaccattattgtcttaacccaatcccaggagagacttttgggaagatcctaacaagatctcatctaaagtccatgcaaagtcgatctatagcaatttttgtcaagtcactatcatcgtcttaatctaattctttgagggatgttcaaaaagatcccaatgaggtcttgtctgaaatcaatgccaagttgtttcatgataatttttgccaagtcatcatcattgtcttaacccaatccctaaagggatgtttcgaaagatcccgattaggtctcattcaaagtcaatgcaaagtcaattagtggcaatttttgctagttgccattgttgtctttacctgatccctaaagggacattcaggaagatcccgatgagatcttattcgaagtcaatgcgaagtcaattcaaagtcaatcagtggcaatttttgtcagtcgtcattgtcgtcttaacctgatccttagagagatatttggtaagatcttgatgaggtcatgtccgaagtcgatacaaaattgatccatcataatttttgtcaagtcgccatcgttgccttaacccgatccctagggggatatctaggaagatcccaatgaggtatcacccaaagtcaatgccaaattgatccatggtaatttttatcaaatcaccatcctcatcttaatccgatctctagagagatgtttgggaagatcctgatgggatctcgtcgtggaggtcccaacttgggtcaaaatatcttcttatgatcggaatcttaccgatcaccattataaaggtcttagttgtagccaaaatatcttcatgaggtcgacacttttcgacctagttgctgggtccaaatcgaggtctaaatatctcgcatcgaatttcctcccatcatcatctattaaggattgatgctagacttggtgttggggtttggcatctcgaattcgacccacagcagaagagaaatccaaatgcagagaaatccaaacatgaggagcccgaaaatacagtctgaaggcctaggcatgcagcctgcagcatgcacggcccagcggggcctgctgtgcgatgggccagtgcacaggtgtgcggatgcatatggacgcacatggcccagcatgggcataggcatgcggacgtgcagcccaagccgtccatgtgacacgatccatggtggactactggaggaagtcacggtccacatgtgttctatggactgccatggtccaaggggcaaaaatcatagtgcataggaggatttgtgcgatccagcggtcaggaaggcatgcgatcgtgatcgaacgatgatcaagcatgatcgaaagttgtattatgtaatcggatggccaaaagcgcttgtggcaaagatcgaatggtcagaaagattgatgagtccttttgaatgcaggaattcaatctagattgattttagaccctataaaagagtttggagaggctgtggagcagaggtgaagcagcttgatgtcagtagctgcttctatggggcattaggagcagcttgtgtgtagttgcaaaagtagtcgagagtgtcctagaacgatcatgggagtgaccgtcagtataggaatagaggctgagatatgatgtagcagctgagagcatcacaggaagcatctagaggtgtcaaggattctggctcgataggcctgtgagagggtctccttgtgggattttatatgagcttttatgagtgttgtgcatgttattgagagagaagttggtatgtgagagttgagagtgagtgatcttctcttgtatttgttattttttcttatagtgaagcttgcatgcctcgtagaggcaaaccttatgctgatccatatatttaattatattttttattttatctcttctttctttctactgcaacaagtggtaccagatctccaataattggtatcagagccatatggtactaaagagccaagtgataccagagcgtcagcttgttcgaactgtggtggtattgatcaagattgaagaagatggagaagtcaggtataatcatggtggagatcaaccataaagggttgatcgatactctcttgtgtaaagagaagccgtctaccaaagaagatgtcagtgggagcccagtatgaggtggagctccacgaggaggtagattaggcacgagattagagatctaagagaatgataagtgacatcaccatgaggctatcctaagcagatcttaggttagagcatatgacagagatggaatcgagcagtctagctcgaccccatgtttgtccatctatgaatagctggcgtatgactcaggatgtgggggcaagaagatccaaaagctctcaaaatcagatggagacagaatgtcgagtcgagatagagatagttgagatttggtaccttgaattcgatctacaacagaagagaagcccagatttggagaaattcatatgcgaggagcctaaaaatgcagttcgaaggtaggcctgtaggcttggcctatggcctaggtgcgtagtgtgtgacgtgagtggcccagcggggcctgctgcacttaggcatgtggatgtgtgtggcctaggcatgggcgcacagatgcgcatggtcttgtgtgggcctatggcctaggccgttcatgtgacgtggttcgtggtggaccgttggaggaagtcacgatccacacatgttctatggaccatcatggtccaagaggcaaaaatcatggtgcataggaggatttgcatgatctagcgaccaagaaggcatgcggtcataatcgaatggcgatcgagtgtgatcgggggctgtattgcatgatcgatggccagaagcgcttgcggaaaagatcgaactgccagaaaggttgatgagtccttttgaaagcaagaattcgatctagattggtttggaccctataaaagagttcaaagaggttgtggagcagaggtgaagtagcttggcatcagcagctactttcaggaggtatcaggagtagcttggcatatgcagctgtagaagcagccgagagtatcctggaatagccgtgggagtgatcatgagtgtaaggacgaggctgagacatgatgtagtggctgagagcatcacagaaagcatctaggagcattgaggatcctaactcagtagacctgtaagagtctctttggaggattttgtgagagtttttgtgagagttgtgcttcttgttgagagagagattggtatatgagagttgaaagtgagtgctctccttttgtacttgttattttctctcatagtaaagcttagatatcccatgaaggtaagctttaggttcatccacgtatttgattgtgtacttattattttttccatagtgaagcttgcatatcttatggaggtaagccttgggctgatctatgtatttgattgtatcctttatttcatctcttctttttttctgttgcaacaaatggtaccagatctccaatacttggctgctagggtatgcttcttgtgatatttttgatcattcctagtagtcaatgtcaatcgaatgtcttatgtatttgctttaatagaaaacttgcagcatgatctaaaaaaaaatatttattagtataaccaaaaggtgccaaactcatcagtggtacattttcattgaaagggataatggagtttcccacttatcatctctttaccctcttgatagatcttctgccattcgaccgcctatgaatctggagatcacattgatgacatcagctatggatcggttgttgctgtcgttcttcttatcggactgatgctgagatggctcttcggacgcttaggtctatcgcctctgaagatactttctgaggtagcttttctagattagagcttcgatctcatccttgagctagaggcatttctcgatgtcgtaattaggctcctagtggaagcaacaatatttctccttactccttgttggtgggccttcattggttagggtcgatgaagatatccctggccctcgatttctatcaagatgtgggctcgggggccaaataggagagtatagttgttgaagtatcgagggggactcctcaacctaaggctctttgatggttgggagggcccttctcccacctagcccatgcaaggctcttcctgacttcgcttcttattgggggtcttcctttattcagcctacttccctgtggcccgagcctcttttgtctatgcatattttcaagcacatataagtaggttggtgtagtccctcgagaatattttattgagggagaagatgaggtgctcattccataatcctcacttgagcaccgacatcaccttcgagtcatcaatattgtgcaagcatagtagcattgaaacataccatatagtcacacaacaactcatcctcttcctaccagatggagaagaagatattgatattttttgaggtggtgggttcggagattggggctgctttgccacttgctggagttgctgcaccatgcaagccaacatttggatctgttggaccaaggtctctaggggttgtagatcgatcgtggtgagggggttgcacgatggcggactttcaagtggtaccgctttggctacgatgagaggatcatcgacaaaaggcattggagttatatgctcttattctagccattctcttcttcctcattaattgagttaatcacccttcctctggtatccatctattgctgcaagattccaattcgacattgatgtggctgaggatggatatcatttggggaccgagatgccaaagaagaaacctataagagaagtctgctttcattggggtttctccagtaggcaaccctccaatacttgtcagctggagtttgagaatagtagaggaaagagattgtgaaagggagaaggtgtgagagcacatggggcattctctgaaattaagcttatctaagggtccctttattacctctttatataaaggtgaaaatttatgttgtcatgctggaacttagtaggctatttgatcctaattttctaggctgctaggtctcaatctgatatactattaggactggagatctgcccactaacctatatactagagttgttagttatggtgtcagttatggatcatgtccacattttgttaagagattccaaggatctcccatatggttgaatagtttgatgtccccagattggtgccgagtcaaggttctgccctaagttagtacccatgtaggttatcgggctatgttcatcatcatcagtaggatctcgaccttcgggttggtaagtgtccaactaggaggttggatagaaaccgatgacgtaaagctgctttgccttggtttctcaggtccttcgatatccaatgttggtctgtcggtgagagctcagctgtaatccgaggaggagatgtcggattgggttgataacccccacaacagctagtgctaaagttaaattgacctacctgcacctagctgcaagaatcattacattgtgctcttgcatgataaaaccaaatgcctcttggaatcaagtccctattgaaaaccaccatcaaaattgaccttaaagtttccaatagtaagggactgctggtagatcaattgaaagtttagtgaaataggacttggacaataaaggcctttacggtgtgttagaacctacacttttcgattatccatttgagaaattaagtaggaattctgtgtttggttggggggagttggggtctgaaatggaaatgacaatggataactctcattctaaccatttggttggaaggggtctgatcttgattctaattctgaagtggaatgaaaatgatcgaatccccctaaaacccaatcctcactccttcaagaattcaaatttttattttgatttctatttcgatttcgattttggtcatgaatcaaatgctttgagagatataactattctgattcttattccaatctatttcaatttcgattctagtttcaatttcgattgtaaattaaacaccctctcagaagatactcgagtgtttggttcacaatcagaatcagaattgaaatggattaaaatgacaattggaatggccatatcctccgaagcatctgatttatgatcagaattagagtcagaattgagatttgaacatctttagaggagagttgggattgggttttaggaggattgggcttttcttgttccaccctgaaatcaaaatcaaaatggaactctctagccaatcgtaggagttcccccaaccaaatgccctctcactgcttttgtcactaaagtcttaggttagcatatgttaacttgttttggaagagactcccatcctagtgactccatgacagccattcgatgatgcagaggaaatgtttaattgaatgtaagtgttattaccgttcaataaatttagaagatgaacaattatttttttagcaaaggcatgatatttatgccgagaactactgggcaacatggatggccaagcgtttacatgcctataaacaaatcaagatgcattgaaattgcattttcttatatgacacatgtgatgcatatgatctgagtgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttagaactactttgatcgataaagaaagatttatcgtgtagtccttaaattggtttatgaccaaacgatatgctattactaggatgatagtgatatcaagtataggtcgttgtgtgccatatacgttggttgtcctcgtaaccaaatggtgtggagatactggtatggcatgcgggtgagatatagaagtacatcatcactgaacgtgaccaactacggagcaatctactatcaaggatagctcgtgaagggtatggacataagtatccctccgatcttagatcatcacggtgacttgcatgcaactcactgtactttgatgccagactaactgagtttctaattcagtgacgaaagatttttagttacaatcaagtacttatgaagttggtgtataagtcaagatgggattgatcccttcgaattagtaggagttaatatatcaatgtatttcaatttagtaaaatctggacccaaataatccatgtgatggatttaaaaaaaattgaaatacaatgtggatgacttatctaagattgacaattaaattcttggtcattcttgagtattagagtcaaagggatgaattatacgataaccatatgccaataggttgttgaatgttgcttcatcttcattcgatctatccggatgttgggtcaccattgctagatgattacatcgattgatttaaaaaattatttttatgttatcaatttaagttcgaacctatgaagtcatacttaaaaaaatttatgattgatcatgcggctgatcaacgattgagaatcgttcaagggcttaatcatcaattcgattaatggttaaccttatgcaaaaattataataaattaattcatcaagtattagtaaattaataaaagattaattaataattaaattattgattagcttagtttgattgagcaaagaggatcaaataaaatctaattgagttggattcaattaggtttgacccgattaggttatgagatgatctaatcgctaaaggagaattatccctgatttatcaggattttgattcaatcaatttctaatttgattaaaaatttatgaatctaattaaattgagtttcatatattttatttgggctaaaacagacatgatttggtttggattcaaataaggaaattaagagtccttattggaatagaactcttcttccatgtgcctcccactttgatgccatatatcctcacgcacaaatagtttttgtataaaatttttttatgtcaaagagtgctttcccttctctatctcacatctaaatttgaataggattagattttaaatggtgtgttcaaatctgatttaaaataggataccatatagataatgtttgacattatctctaagaccttatcaccaacttatttttttctcttcatatgtgctacattttaaggatattttttatgaaaaattatttggagaactattttactataaaaaaatatgggaaggggtgttccatattttttttggcatattttgatgtgaatttttgagtagggatgacaacacatcaagagtccatgatctctaggactcttcaccccacctccttacatgttgaaataaaaggagttttattttattcttatgtgtggaagagatctgagagagaggccttcatgtttagaggagtcttgggcatggtttcatgatgtgaaagaagaggagagtcttcttctcttgggtgtgcataaaaattaggtttctaggattttggtccttagggtttgagaagaaaaaaaaataagaaaaaaattatttttctctccacttcttttacctcttcatctcctccagaagtacatctttaatctctaaaaaagttttagagatttgaagaaatgatccaaatcagttaagaagaagatcttcatgtgagctagcactttcgagaagatcgattagatcgaggcttcaagtagatttttcatagaggccggacgtgtgtacgactgcgagcaaccagcaagaatcttttctaccatatctctcagtagcagagatcatcgatccacgctcaggtatcgagttctgaactcagattagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtctggacgtcgcgaagaatccggtcgacgctggcagggtcctacctatcagcaaaacttgggaatgtggcggaggctcggccgcccgggaggtttgaagagatgttgtcggaggtcgaaagtcagttggatccccggagggtcactcccgtcacgaacttcggctggggggtattttatacccaacagtagttatcttttgaattgcaataatattattatcgatgatttcttaattaaaataatatctgacatcaatgtgcttggtccgctcatgatatattaaatttttgaccaagtggacggcactttagctatcacaatgtacaattatccactattgctatagctaaaactatcaacgaaacgatataattttgtaactttctttacttcctcaattacagttatatgctgtgcttcggttgtaaacaaagcaactttatcttgaagtgtagttttctaactaacagcacaatcaaagagtaaaaattttctatcaatgattgttactaatccaaatcatctacacaatcaaaatcaacatagtttgtactattagatgatctgctactataaaagattagggcaaggtctgtaaagcttctcgaatatctcaatctattttaagaccagtaaaattgctcaaacactgatatactagctaatttacactaatagcatatgaaatattggatctagtacacattatagaatatattaagctaccaactataccggtatgtagaacacatgatatgtgctgtacctcctccatcatttgcaatgataatgaagctaataatctaaagtatgcagctaaaagtgtactcaatagtttggatctcatgtagaagtgttcaagcatcttttctatatatttttttgagataaatacaatcgacctgtgcttatctctataaatttatgtctctaaaatcttcttttccacatccaaatttttcattttaaattcatcattcaatataattaaagtttcaacctattaattttagatttatccttagctgcgattaacatattatccccaaaatcctctgcatgcttcgagatctccactatataaaatggtccaattttggctctctagggcttacaaattcacaacatacttgacacatatgaacatggccatttaccaaatgtcatacaaatggatgtgtgaaaaatgtagtagtatcacactatatattgtttaacagaatataataatgtgtaggtaaatgtcaactaggatgtggacctatgacggaggtggaataaatatcataagtgaaaattggctctatgtcaagaatgtaaggtacgatataattttcttagtttggtcattgatccaggcgatctaaaaatgatgctggaccagatatcctatagaaattttgaagagataatgggcaccggcaaagggcaatatgtcaagagatttatcaggatcattaggtgttatgtagatcagttatggtaagatcatcagctacatttgtagtaaacttacagtatcagttagtactcttaagctttgcagattatgtggaactagttggttgattagaccatcgaggatgttgatggacgttaaaatggacattagaatgggctttataggattgcgaatcagtcaagccaagaggtagtttagataaatgaggaggtcgccttgtccgcaactttgatggccaagagatagcctagataaatggagtagtatacccaacattagattgggataatagaaaaggattcctgcttctagggggtcttgtggttgttagatgccacctggactttgtgaatagaaatggcagactatagcaaggtctaggaatataacacacatttagaatagatgaattaatggtcaaggtgtatggcaattaacacatgggatcatggagttaagcatgagtatcttgtaggcagtcaccaaagtcatgctgctttagggattgaagtgatcaccaaagagttcatggtgaggaagaggagcttgaagtggtataaggtgaagccagatgtggaggagtctagttggctattgccatagaagagaaaacgaagtccaaattgatcttttaaagagagtgcaccatagcaaccaccaatctaatatgaggatctatacaggtatatatttagttctatatcggttattcgctggaaagatcttaagtacttatacatgatcaaagaatccaaataataccttccagctagctttgttggatgagattttagattattataaatggtatcagagttgattcaatacatagcctatgtagttgatactgcagcacaagtttattgagcctgatcacatgctaattatagtatttttgaatggatgcatggattgaaatccttagtctagtaagaacattaagatttacattaagggagtatgtgaggatctatgcggatgtatatttaatctcacattaattattcaccgaaagatcttgaatacttatataggatcaaggaatccaaataataccttccgactattctttttggatgaggtcctaaattattatacttagctaattaggtatgcaactccatccaatctttgtagcatatgcagggtggatgtctggccagaacaccacctcccaagatattttcgatactacgcaatgcagcaggaagaaagaagaaataaacagaaaacaatcaaatacgtggatcagccaaaaaagagctcgcctccatggggcatgcaaacttcactatgaaaaaataaatattacaagaggagatctcatcctcaaccctcgtacacctaatttcttcctcatagaaagttctctctcacaaaagctctctctctaggaagacccctctgaacccctgaagtaaccactgttcgctgtctaggagcctcctgcttcttcttctctcagcgacgcattgcttctctatttgggggttcactatttcctggtttccatgcgaagacgtccacgcccatgaaaccaccagtcgaaccacaccttctgttgagcatcaggcccttttaaagggcttaaacatccattagaaagggattaggactcctaatcaacctcaaatcaagttccaaaccgttggatcaagatcaggatcaacccacaccattggatcgcactccgatctatgaaatagtgccgtggaccgtaagaaatagatgagaaacggctctgcggtccacgtgctcctctgtgtaccgctcggtccatgatggatcgggcaaactggctcgctgcacgatgcttgggcttgggtcggcctgcgccatgcgcatgggggtcggaccgcacgccccacgcacttgggcctgccgggcccgccggctgggccgcgccctgcgcgcacccagcccgtgcgttggccgcgcttgggccatgcactgctacatgcggccgcactgccgttgctccaccggcccgccaccggccgccgatggtcctccaccacctcagattccatgcagacttcaaacgtatgtatctcctccgtccgagctctgtttgagatgatcttggtctcgttggacttcatttttcatcgcagacttcactgtgagctcaatgtggattgaattttgaggcatcaaatcctaacaatctctacctcgactcaatattcggtctcctcctaacttcgagagcttctaaatctcctcacctccatgccctagggcaatcaactgctgatcatagattgataaatataggagtcgagccaggccactcgatcccatctctgtcgtatgctgtgcttctcctaacttaagacatgctcggggtatcatcctacagcaatagaaatcttaccttacgacgtcacttcttgttctcctgagtctcctgtctcatgtttgatccacctccacctagaactccacctcgctctaggctcctcctggctcttgaagctccacctcgcactaggctctccgctaggtaataatatcctctcctctccttcttctccttcagaacaatcctatcgccatgtagcacctttaagattcctccaccagctaccatcctatagcctcttgaattcagtctgcttaatgagataagatttcatctaaaatcagatatgtatcgaacctcccccaatcttcttactgcaccatcatgtgtcctctagctgaccatcccgatgtctctgatagcgcagctcgatctatccgacagataaatagtatcttcactgttctctaaggagtcaaactgctcctctctgtaacatatataatgggtgcatgcagaatctaatatccactgttgggaagaagtagatacctcgtcagatggctccaagatatctccctctgaattgttactggccgtcgccacagcagtcatcgtctgatttttgaattgagagcaatctctagctagatgtcccaactcgtcacactggtaacacctgatcttgctcaagtctctcatggacttggaccgctctcgtcgcgatctcctatcacaccatctactgcctcctgctcctccaaaagccaccaaggctaagctaccgccacctgagcttgaagccgagttctccctcctgagaatttcgttctagagtatcaccgtggtgacctcatctatcttgatggtgctcttctccactagaagagcagtcaccaaggactcgtacgatggtgaaagcgatgccagcaaaatcagcaccctgatcttctcctcaacattctcatcaatgctaaagaggtcggtgaggatcttctagaagtggcttagatgctcctgcacgctctgtccctcagtcatttgcagctggtagaactgcctctagaggaaaagagtattggtgagagacttcgctatatacaactcctcgagcttcaaccacagcaccattggagaagtctcactaagcacatagatcaccacctcatccgtcaggaacatgtggatggtactcactgcctgcatctgtagccatctccaatcctacacctccatggtggtcagcttctcgtcgcacaagaaagcatcaatcaacccttgttggatgagcacgtccttcacccttacttgtcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaccgccgttccaccggcccgccgccgacggtcttctagcatctcgagtttcgtgcagatttcaaaacgcgtatcttctctgtccgaactccgtttgaggtgatcttgatctcattagactctgtttttaatcacggacctcgctgtagaattaatatagatcaaatctcaagacgtcaaatcttaacgacatatgcttttatacccatccaatctttgtggcaagctccaacctacgtgttttcatcgagaacttgcactacgagtgtaataacccggctcttaaacccctggactggctgaaaatggttggccctactttaatctgaaaacacgtgcttggcacgttggagaaggggaggtagaggactccgaccgcgagtcttcttctcctccaatttttcattgaaagccaagaataatcccaccaaaacttagattaaaacgaccccaacttttgtctataagtactcctctctcttccttagatttccaccatcaaatttcttgggacatcgctaccgattctgcgttgtttcaagcccattttcttgggatttcgtcggagagatcgtcggatctctcactattggatgtcgccgaattaagacaacattctttcccttcttctcctcctttttctaacatcatcgtcaccagatctgatcgatgagccaccaagtgtattgtgaatagggtcttccctgttcccttgattccttcttttgttttcccgaccaccggtggttatgaccgctgctggggttgcgtctcagttggcatcgggcgctgccattggctgtcggcctaggtccccatggccatgaccgaacaaagagagaggagcagggggtgttcgtgccctgtttttaaagaagaagaagagacggagaacgttgttctcttctctctcttccttttatttaactcctccctttctctctcattaattaggttgagaaaaacctttaaaaaaataaaataaaataaaaagagaaagaagaaaaaaaaaaaaaaaattaactctctctactttctctctttaaaattttttttcactagattattttctctaggagtctcgtagactagtggagggtccaagtacttatataaatttaaattttagttgaccgtaggaagagtcctggatttataatattaggatcattcatcataattttttactatctttaatcatctatgatttttatatttgactctgatcatatagagatgtgactgtttatacaaggtgtcaagtggaagattttatttcgagttcatagatcgaggagttcatcgatttctgtatatgggacaatcaccgataaagataaagattcttggacatgaacatcgatgtatatatatatttgtactgcatgatttggtttcttatgactaatatttattttatatttgtcggtatgattatctatatattctgtatcatatgtttatactgcatgatttggtttctcatgactagtatttattttatatttatcggtatgattatctatatattctgtatcatatgtttatatcaaacaacaattatttttcggatggtttgggatgtgataccggttattgaaaaaataatataatatagtatttttttgacataaattaagacttaataaatggatgatcaagagaggatatttgaactagccatgttaaactgagaatagcctgtcatgggcaaagatatggcactaagaataatctaccatgggcagatacatgctatcgagaatagcctgtcatgagtagatatatggtaccgagaatagccccatcatagacagatgcgtggtatttgaatttttcactttaagctgaagcacagttattctagtttgccatcgtgggtggaagtgcggttattctagtttgccactgtgaacgggatcatggatataaaaatttaccattggttattagggtttgtcagttataggctgaagcatgatcgtgattagtccaaaattctaaagataattatagattaatccagattaagttaatgagatatgggtgataagatataaaccatgattaagtaaaaagaagttttacttgattacataagtatgatatatgacttttagaaaagatggatttttgatgataaatgatgcatatttttatattgagctatattggatacttgacatgagattttgtgacttatatttctttgatactatttatatgttatattagaattattattatactggtgtgagtgtgtggggatttttactggactgtaaagctcaccaccccttttccttttttttttttagtagttacaggatacatgcagttggctataattgggatttcgatttgaaaaaatagattagataaaacatcatcagtatcagttggaggatcgagttttgtaaactgtacaaggttgatatttgttaatatgaaattggatattttgaattgaggtcgataatgattataggatattgagattgtaagaaattttatagattttgcatgttctttaggatttatcctaaggagtgtacagccatcatgtatcctatccgaatgctgaattcgagatgttacaatgagtcctaccaaataatgtgctcaacaatgattggtggtggcattcagtctcaaaaatcatcatggatgaatacaaatagatgcggtatccaaatcttgcctatcaactgttggatcatcctctgcatagctttcaaagcacttcatttgcacaagtttgaaagagaaattgggatgacccaatggttgacatatgcgaaggaagatgaatcctttcacccaaaggacacaaccatgctccaccctaccaatcctcctccatagagaattcttgattcgatttactctaccacgtgtgttgaagacaaagccaatgaaaaacataacatcgcagcatacatcaatgtgttgaatggttaaggaatgataagagaaattgttagttagaattgttctaccatgtatatcttagactatccaataaattaagtcaacatatcatcatccattattggaaaaaaggttcactggtaccaagcttggttaaaaattttgaatgaaaagaggtttaaccatggacagcagttcgcacattttactattttgaataaagaaaagttcacttttttttagatgatgtgttgattttttattgaataatctaaggtacacatgacagagaacaatactaaccaataatttcttagtgtgttgagatgattacaaaattcttaaattcaaaatactaatgtagcatctttttattgagtttgtttacaacacatgtggttgactaagtctatccaagaatttttcctcctccatgcagtccctacactcgctaattagataccctcatgtgcggcaaccccagcatccatcaatgctaccgatgacgctgaggccgctgctaagtttgcattgtaggtaggtaagagagattctttgtgcaccacgggtgtagaaaatccgatgtggagcacattgttttatatgattggtctacatagccaccacttctcaatgcatatttataatatcctatggcatattatgactgcttatacgccggatgtcataatatggcccaaaaaattatgacatcctatgacatattatgatatcatatgtcaaattatgacttcttgcatgcaagatgtcataatatagaccaagatgttataatatagaagaggtatttttgtccaatcacttttcaatacacatttaatacatgcagtttcactattttgtttgaaaattttgaacgacgaaaatacccttgctctttgaaaaaaattatgatatcctgcgtcaaaattatgacttcctgcacgcaggatatcataatatggacataagatgtcataatttttttaaaaaagcagagatattttcgtcattcaaaattttcaaatgaaaaagcgaaactataagcattaaatgtacgttagaaagcggtgactacgtggaccaatcagataaagcggtatgttttatgtcgaattttttataccatctgcggtgcacaaaaaattagccttataggtaaaaaggtcatgaatgatgggctgggatttggcggtgccacatttggcgcatcaattaccaattctggccacgcccagcccgcgccagcacttgacccagtccatcgtaaggccacttcaatctgttgcttgttcccaagcggttggtttaggtgaacgctcatcaaatcttcgaaatacaagcgctaaccagtcaacctttcagcactatctgtcgtaccccgatggcatgtacctggatcgccgatgctagattgcattacgggaaaagaccctgcccatagaatgttgttcctccatgtcgccttctgatgaccttttatttgctggtttacatgctaatggaatatccttagatgccgaatcaggagtggaaattaattttacaaagcaatacctagcaagatgtctaaccaaaacggttcatggctagaccggcttccctcctcgatcgtcaataaagtcgatcaaaacccgagggtctgcaagtttggcatctttttttgggttttaatttgtttctctacagaccattgaagcaccaaaaaggggttgatgttgaagattgaatttagaggaaaacttctgctattcattgctttcactttcatcttgaaatcaataaattttcgcttccaaaagctttaaagattgtacaaacagcttcaagatagaaataagaaggtttcttcacacatactgtacgttcagtgccctttggttcatttttcttcttgaattatctagaaaaaacagaaaactgaggcatgcatgcaatacctagctaccaagatattattaatttatggactggctgagatacgcggtgccatcccataaatccaccaggctgcattcagtcatcagtttcgtttcttctaattaattgtttcaaggtgagtaaactagaatctggttattcccaccagtctgcctctcgacgcacacctcatcatgaagtgcacgtaggcgtctccaaagttggtgaagcggcgactcaccagacgtcccagccgagccttggcaccacccctcttcccactcttcgccggtacctcgctgctcctccgtgcctcatcatcgttgacttgcacctcgggctcttcctcgaagatggtcgccaacccgctcttcagtatctcctcgatgttctttcgtgactcagttcgaaggcccttctcaccggtgcaggagatcacccataagaacttagaccccctttgcttcatttccccagtccaccactacttttccttaggaacttggcggcaggagggctcaaggagtttgtgagatgttctgtgagactagctggctattttgtgtctatatatatacatgtgtgtgtgattgtttaggtagtacaaagggaatgaattataattaacgatcggtacgcgtgttaaaaacagctggctcatttgatcaagactttggcggggtcagaaggctatatatattacagaggaggagcaggaggacttgctctgcagatggagtcgtgatgatgtcatcttattcttgtcacgttgggtttaattaattaaccctcagaccatcacattccatggcataccattttttttcttttttcctcaacaaggcaaggttccagcgcgacgcggttgatttgtatctggttttatgctgcctgtgtttttggatatagtactgcagctggatcttcattacctttttctttataaaaaagtaaggggagattgtaatcagctgttccatgatctctgtgcggcaaaaattgtttgtcatcttaacaagaaagacctggtaagagttgaccgtgtcagatgcaaagaaataatgaatgcgagatgtgttcttcgtaggatcgggttttgttcacgtacgccacgtctaaaatctaaataccacgtcaaaggcttcggttacgatcacagtatccttccctgcacgagttaaacgctttcaaagcctgttggaggaggctttacgtcgtcgcagatgcagctcaagcccgataggcgagtaaactcattgcagcggctgggagataaagccacctcaggttatccgaaatacaaatcaaaaagttggaagcagcgagccctcgtacgattgaccacgaagcgtgtctttggtctgtcggacgttgcgtcctgacgcggttcgcatatgacatgattcattggcttccaagctgcacttgtaatcccaaaccctttggagtctctctctggttttgcattaacaaaacatacctttgcagataagttattgtaactcttcaaccttgctttttatctttctttgtgctcttggatgctgttataagcagaaaattcttttcatagataaagctgatgcgcaaaagagctgaactcccggctcatagaagcaaccgacctaagggtcggctatcgattcgaacgctgactgtcaaccagcacatcgactacagacctttgtcctctctgaccccgacgctgatgccaatctcaattttggccattatctcaatcgtcattctaaaataatgggctgaggatgccagcacacctatcaaatcaaaccattaagagagagtatttgcttacgcatggagataggccacatccacctcctggctcttggcaaaactaatatgagccattaagtggttagctactcaaaatcaggagaactagctaggtgaggatttaaaaagatatatccaccggagacaaaaggatgctcaccgcgctcttcgtatgtttctgatctttgtatgtaagtagaggcaaacaaggaacctcaaaggtatgaataactctaaatgctcactctctcccatttgttctcgatttttaacttgagcattggagagtctccactggagtcatctccagctagggactttatttgcagatcctactatcatcgttctcgccgaacctcgatctactccggccattttaacccaagccaggaatcagtgacaacatattggcactagaggaagggtccctaatcgattgagtttttcttgattggagggctactattgtaaggatttagtcccacatcggttgtgagtcaaggacaactctgccttatatggtctggggccttccacccacgtgaggtgccttttgggtcatctcattagggcaaaactatgcggagattataaaaaaatggctccagagcggacaatatctcacagtagaagctgagggggatgggggtaggaattacccagtcaattgagtttggagttccttgtccacaacatatgctagtggtgaaaagaatttgtattgagtttggagtcccttgtccacaacataagctagtggcgaaaagaatttgttgttgctttacaaggcatgccttgtccacaatatatgctagtggcggaaagaatttgttgttgctttacaaggcatgcgacgatcatgactagaatattttgtaattacgaaagttagaagtttcaaactatgatcaatatacgattatatacaatatgctatcagaaaaacatagtatgaattaagtccttggttccaagctccgaagattttaccgactacactctagtcggcacctatttaatcaagacaacagtagttgccaaaaaaatatcaaatactatatagacatcattaaaagggggaaaaattggagtaatcggtgtgcggcacttgcctataaaacatgatacgtttgggccattggtcataataactacacatgcatgtatgcgcaggtttctatctctgctagcatatgtgtcttggatgagaaacttcaacttgtttctcaatatgggtgtcggatacattgtttctcgatatgagcccgccacttctcatgtcccaccatgacttcggctgctgcacgggctgtttctatggttgctgatcatcggccccatgtgagtcatgttagagtggagggtgactcccttactgtcatccgttggatcgaccagtaccctcagccactgcaccaacgatctacgccacctttacttcgtatgatatcgttgctctgagatgccattttatttggttttgtgttagccatgtgcatcgccgagcctatctgtctgctgagtggttggcctcttttggtgcatcccatgtgagagccctctttcggactacccagctacgcctgagcgctgaccttgtacgcacggaccaagctgggtgtgtgtgtttcggcttggagtctaacttcctctagtaatcaagaaatatcaaatttattaatctgaatacaagttttagtcttctgcaagaaattttttatacaaccttttatttttgagaaccaagatggaaggattcttggtcaaaactgtagtgaggagcgagactgagtccaagtcaccgatatccaaatgcaatgactttattaaactcaacgagttgattttttttcttaaataaatatgttctatgatttgttccataaaagttatttctaaaattcatcaatttttctaatatgatttttcttagaaaatcctattagaacaaattagttgtcaaatttggtcagaaaagttagtgtggatcggaaactatttctctctctctctctctctctctctcaccggtaattctacatcccaaaaactcatcttcgttgatatgtcataggtttcatgatcttctacattattaaaattttaaacttaaatttagattttttcgtagttgatagcttaattatcttgttggctattctctttccaagagagagaacaaattctttaaggaaaaatttataaccatgtcttcatatttctcaatattaatgaacgttggtgatttcatgcatgtattttaaaattttttaaataaattataataaaaggtaattagattaatcaaattaatctaacatacatatgatttaattattaaatcaacctactctaggatctatgacatgatatattgcatataaaatctgaaaaaaattaaatataaaatcagcatgcatgcatgcatgtgagcagtagatcacatctacttttaatctgagttcagaactcgatatctgagcatggatcgatgatcactattactgagagatataataaaggagatccttgctagttgctcgcagccgcacatgtgttcgacctctacgaaaaatccactcgaagcttcgatctgatcgatcttcttggaagtgctagctcgcgcgaagatcttttttttgactgatctggatcttttcttcaaatctctgaaactttttcaaatgttgaagatgcacttctagaggagatgaagaggtgaaaaaaaatggagagaaaaatattttttttctcttcccaaattctgaggaccaaaatcttaaaaacctagtttttgcgcacaccccaagaaaagaagactctcctcttttttcacaccatgaaaccatacccaagactcctctcaatgtgaagacctctctctcaaatttctttcatatataaaaataaaataaaactctttttattttaatatgtaaggaggtagggtgaagagtcctagagatcatggactcttgatgtgttgtcgcccctactcaaaaattcacggctaaacataccaaaaaaaatatgggatgcctctttccatatttttcattgcaaatcgattctccaactgattttttatgaaaaatcttctcaaaatgttgcacatataaggagaaaaaaataagttggcgacaaggtcttagagataatgtcaaacattatctatatgatatcctatttcaaatcagatttgaacatactatttaaaacctgctcgtatctaaatttggatgtgagatagagaaggaaaaggatggcatgaaaaaattttatacaaaaactatttgtgcgtgaggatatatggcgtcaaagtgggaggcacatgggagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcctgatcaaatcagggataattctctcttagcgattaggtcatctcataacctaatcggatcaaatttaattgaatctaatttaattatattttatttaattttttttgctcaattaaattgagctaatcaataatccaactactaattaattcttcattaattcactaacacttagtaaattaatttattgtaacttttgtataaggttaaccatcaatcgaattgacgattaagtccttgaacgattctcaatcattgatcagccgcatgatcagtcagaaacttcttttaaatgtgaccccataggttcgaacctaagctggtagtacagaaataattttttaaatcaatcgatgtaaccatctagcaatggtaacccgacatccgtataggtcgaatgaaggcgaagcaacattcaagaacctattggcgtatggttccatataattcatttctttgatcctaatacttgaggacaatcaaaaatttaactgtcaatcttagatatgtcatccacattatattttaatcttttttaaatccatcacatagattattcgggctcagattttgctaaattgaaatacattaatacattgactcctactaatttagaggagtcaatcccatcttggctcatgtactgacttgacaagtacttgactgcacctgaaaatcttccgtcattgaattagaaactcagttagtccggcaccaaagtacagtgagttgcttgcaagtcactatggtgatcttaggttggagggacacttatacccatatccttcccgaactatccttgacagcagaatgctccatagttggtcatgttcaatgatgatgtactcctacatctcatctgcatgtgataccagtgtctccacaccatttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatttatcaaaatatacgttccaactctgaaatacttagcattgccttaggagaaaatatctcattatggtcaatatcataatgttaacaatattcttagaaaaccagacgagctttgtaggtctccaccttctcatctgcgctctctgatcctattgaagatccacttacaccctatgaattttacctcttcgagtggatcaatgagtgtccatatatcattgaccttcatggactctatttcagactctatggctccaaaccactaatcagagtcgaacctctgtatggtatccatgtaggcgatcagatctttgttgttctcatcgagttcaacaggatcacattccaaaactaaaaactgaagtatctatccgacggatgcgatactctatcggatctctttaatggtgcctctacaatggatttcagatttgatctagtcaaatctggttctataagttcaccagattgtgtcggttcttctacctgtcgaacttcataagtttcacattaaagatatcagtaccttcatcaaggtactctttttctaaaaaaaatgccgaacaactcttattctttagcatggtagaagttatatctcttagattctttggaatatcctataaaataatacatatagaattgagatccaagctaatcgatctgtaaatgctcaacataaactgaacactttcaaaccctaaggtaagaaagtatcaacttatacctagtccatatcttatatggagtcattgtgactgattaattcggaatccagctcagaacataacaagagtcttaagagcataaccctaaaaggagactgacagacttgcaaacctcatcatgtatcaaactatatctaacaaagttgatttcaataagagagaatcttattttcttttagatatgtcaaaaactcatcggaaggacattctcctctttgttctgatcgaagagtttcaatgctctttctaatttatttttctatcttattatggaattatttgaatattttaaataatctaaatttataataaatatgttcgtatatccaatacatcaatatgtatcagactcagaacactattggctcgttcatcttttctagcaaaagatgatttgatcatcttactaaggcgataggattgataggtcaacaatgattgacaatcattgacttcaaaaattatcctgttgattctattcttgcttcatgatcgagcctaaattgccaaaaataggcttctaagatataatctacttaggagtttgattgttgtgtactatacactaacaggctgtgattattcgtaaatatcatttcttagttgtccacatgattttgatatcattcataatgatatcacaaaaatcattagacaatagtgacaatcaccaaaatgatattgatagaattgaaaataagctcaacgattcttaaaatcaggattaaaacatgacttccatcttcaacattcaggaacctcttactattttcaatctttctactaatctgaagtcgttacaataatttgtatagactttcaatatccaataccgagacagtagtgttatagatagagaaatcacaaggtgttattatataagtaccttatccagcaaccctttactgatttttcttccttagcctgttcggatcaaggaactctatcagactagattaaccttagattcttttgtcagttcagactcattagcccaagcacgactcttttgtaccttttttctttttttttctcaaaaaattgttgccccattaaagacacatctttaaaggtgcaaaaaaaactccttcaacatttgaaggatttcctcctactgaatattaacaaatttacaactaaaattatattctttgctgctctcaaaatacaacacatagtgatacgatcatttggccacttctgataagtgcttttgatcgtatcatatgtgttggacatgagaacttcaggtgctggatccataatcatatgtagaatccattcgtgctctagaactatttgcaacttctgataccatatatcaaagttgggtcctataaataagtcactgtcaaatagtgaatggagcaacaaaaatctagccataactgaaagaaaaaaactcaagacctctatgtttatgaattgattaagcctaaagacttggactttaatctaaaggttctctcattattttgatcgaattggtagcctctaccttcaatctgagaaattatcctaattctttagcggatactagaatccacacaaactgcatacaagtctgaggatagttctgtcaactcatatgcatctatgggtagattctcaactaattatttcttcaaacaatttctagtaattaattttatcccagattttatttcagtaggcgatagatctccactaaaagtttcagttagatcaaaccattaacatgtaaagtttcaattccattatatatagtacaattccagtattttttatatatcgataaaaattatcaaaaaataaactatatattctagaattaaaacaaagagaaaattcaaactagtgatctcttatttaaatagcaaactattaatcatcaagctataactgatataattagcatataaatatagtttatttaactattaacaaatattcatatcattaaataaataatgctaagaatatatatatatatatataatgacatattttatgagatcaatatgactaaatcaaactttatataaaaattaataatttaatatttagctataattttttaaaatctcataaattatgatattatttactagcgtattagttaaataccatgatagtagttctgatttctcccacttcaagttatatactgtaaaatataaatttataatgatatttgtaataaagtactataattaaaaaatacttattgaaagataacgttatttttaccaaaatacaacaaaagaaaggaattttagtggcatataataagaaatactccaaataatttatcaccaaaaatcatttttattataatataactaactaataatacgtgtgcatgtgttcctcttttaaatcaaattcattatttttcaatcttctagcagctttttgtgaggtatcaagatccatactatctataattcatatgaggattcttaatcattcataatattgggtgctaaggtgaatctgcccttatattgtcatgttgcccctcgatagatgggctgcgcagcataagaaaaacttctaaaaattctctttgataagattgtctcctaactcatgtaatgctcacaatcggtatcatgaagccactatatttttgcccccttcttataggcaaacgatcatgaattattatcgtctcggatttatcgatttcactagtgatcctctataccttattatgattgataatctcgagtttcagtaaagtataactaaaacatctcttagtagttcagtgtgctgcggcttcattagtgtgactttcatgttaccttggttagtaaattctgagttcttcatggctgaccaaggtcaattaagtttgcagcgtagcacaatctcggcactctagataagaaagagtgtagcagctcgttcgaaggtcacgtgaccaaatcgcaacgaactctcaccctcctctctatataaaccaggatagagaacctaagtcaaaaaaaaattccccatgctcttagctcattgctcttattcttagaaacccattattctaccaagactctgcttaactcaagtagtagagtctctcccactagatatcgttctgacaaccttttgattgcttttttctcttgcaggtcaaatcttattgtgtagcctagctccagctgagccgatcaatttccgctagatcaataactccatcaggtcggattttggatggttgcagatcgacactaaaaaagggcctgagtttatcgaagatctaagatcataaagttcaagaggaacagccactaatccacattcaaccaagtttaactggagtccaatggcttcaagcatagccccgggagatccccagaccctatagatcccaagcccttcaaccaacctctaggttgtcactatcgagcaattcagcttgcttgtacaacatgtataggctctaaccaccatgtgcaaaacctacaacagccgaacaccaacctgtcggtaggccaattgaaccaagctgctaggttggcttgactctgctgtagctatcccatgcatggagagctactactttattacttgctgttgcttcaaataataaacctacaggagattgcaaaagttttcgaggtttaaggcttgaacaaacaatagcaagaatgaaaacattccaacaaaagagctagactcactagagtagcctgcaattactattgagtgagagtaggagtgtggtaatagccgatctctatggttcttcgaatgggctaagaggagaaggattccttgagagtccaatcctacatgctatgctaatttccatggtttttgagtctcaatcgcattacccccctgtgaccccctagaatttgtttagtaacatgtatcctcttgcctaattttgtttcaatttgataagtcaaatttctttcattacaagaaatataacctgctttcagacctgattctaaaatacaacactcatgcaccaagttgttttgatactaagatatggatttgttatggtggaaaagaatttgatgacatggcatgactcgattggtccaactcagggctgatgtactattcgacatggctggaccaaactgacctcagtcaagtgaaggagctgaataagcagatcaaaagagctctgaggtcacatgtcacgcgatgtgaagttccttagctcaggtggatactcttctagctccttgctgaccccaagccaaccttagttcgcttatctcagttagcagtttttctgccatgcacgaaaggcgtttctctccatcaagctggagataaagcttaccataataacctctgatagttacactgaatcttcagatagttatagtgcaatcctaaatggttacaacacaactccaagctattaagatacgattcacaaaatatttgggatcctacagctataaataaaccaggaaatctatataagataggtacaccttaagagcaaattattagttccagcattattactattgttattattaagatctttattctttccatctttctatcttcttcttcctcatctcctacaaaaacctctatggcttaagcatcgaagggctaagttggagctaatttggtgagtcctctaacctcgtttgttgtcttgtagatccatggaagcaacccatatcgttcagggattggcaacactgtctatgggaatggaagaggaaagaccatgaggctcaaaagatgcaaccatctagcatccattcagccaactttggatggtttccaacgtgaccctcggagatctcgacgccctgcatgggctctgggagtcatcaacgttgaacggttcaacttgctcatgcaatatgtgtagaatcaccatagcagtatggaatctgtgaccgtaggccattcactctccggttaaccaaccaaatcaccaaggtcatctagcgcaaagaagtagctaccctcatcctgagagcctgagggcagactagaggcatggttgctccagatcctgctctccctctatgatagcttccaatctcaacaacccttctccgtattagccagaaacaatctccaggcagggaggcaaatctcaactacaagataaaggagaaaccccaagatttactaaaacctctgttgcggccaatcccctcgtcgcctggtcaccgggaacaagtgcctgcaaaagaagtccgcactgaccggaggtgactccggcggggaccctccgacggtcaagtcagagaggagactaggcaacagtagaaaagaatcaaagagctcagcgagggggggagagagagggtaagcccaaaggtttcaaaagaacctcctccagcactgttgcatccccgttttatagtagagcgtggtatggctccgtcattaatggcacagacaatgagagagttgtcaaatcgccggaggctgtcagagtcgccgtggggctgtcaaatcatcgtggggctgtcaaatcactagggttgacccatgttttgggtggaacgatgtcccagggtggctacgccgcatgactttgtcaggacggcggccctcagcagtcgtacgacgtttgggagagctggccgaccatacgtcggtattcgctgtcgggacgtcggatgatggtccggaggtaccgtcgactggtctggtgccttgcttaagtcggacgtcggctgccacctccgacggtgagtcggtaatatggattcgaccgctcagtcggtcgggaacaacataggtcggttcggccgacactcctttggtcggataatgtcggcagctactgtcggtagtcatcgatcggtgcagtcggtagagtcagacgtccgtcagagtcgtccgtcggtcgtcgatcagatcggtccgagagtaagtcggcgtatgggggtcaatcggtatatcccaacagttgcccccccactcctgagtctgatgtcatgttggctcgcgtgaatacgtgggcgacggcttcgggcaaaaggagtggttttccgtcatgtcttgccccgactctagcgatcgcatcaacgaacgatccgatgtcggtcatctcgactgtaggtcgagtgagcacgtcgggtcgaaggtcgaccaacctccgaacgttgctcgtcgatacgatcattccgcaaagtcgagtagcgtctgacatattcagataggataacgatggcaagtcgaatatccatcatccgacctttggtcaggcgtgcacgtcgggacgtatgataaacggtggtaagccgaatatccttcgaccgatcgtgaccaagtcggtatgtcgcaagtcgaatatccgttgacgtagcatgtcgagtcgtatgatagatggtggcaagccgaatatccttcgaccggtcatgaccgggtcggtatgtcgcaagtcgaatacccgttgcccagaccttggtcgggcgggtatgtcgcggttgtcttggcgttttgccctttcttagtcgaagctaagttggcaagttagccagccgcgttggtcgaagctttttgccctcagaggcataggccgtcggttcggtgatcgatgatcgagctgttgattcgacgatcgacgatcgagccatattggtcgaggcccttttgctttcagaggtcgaggccgtctgttcggcgatcggtgatcgaatcgttgattcggcgatcgacgatcgagccatattggtcaatgcccttttgccttcaaaggtcgaggccgtcggttcggcgatcagtgatcgagccgttgattcggtgatcgacgatcgagccgtattggtcgaggcccttttgccttcaaagatcgaggccattggtgatcgagccattgatttggtgatcgacgatcgagctgtattggtcgaggcccttttgccttcagaggccgaggcagtcggttcgacgatcgatgatcgagccattgattcggcgatcgacgatcgagccgtattggtcgaggcccttttgccttcagaggccgaggccgtcggtgatcgagccgttgattcgacgatcgacgatcgatccatattggtcgaggcccttttgccttcagaggctgaggccgtcggttcggcaatcggtgatcgagccattgattcggcgatcgacgatttagccgtattggtcgaggcccttttgccttcagaggccgaggccgtcggttcggcgatcgatgatcaagccattgattcgacgatcgacgatcgagccatattggtcgaggcccttttgccttcagaggccgaggccgtcggttcgacgatcgatgatcgagctgttgattcggcgatcgacgattgagccatattggtcgaggcccttttgccttcagaggccgaggccgtcagttcgacgatcggtgatcgagtcgttgattcggcgatcgacgatcgagccgtattggtcgaggcccttttgccttcagaggccgaggccgttggtgattgagccattgattcgacgatcgacgatcgagccatattggtcgaggcccttttaccttcagaggccgaggccgtcggttcgatgatctgtgatcgagctgttgattcgacgattgacgatcgagccgtattagtcgaggcccttttgccttcagaggccaaggctgtcgtagatactccgctccttcgatctctatcaggatctgcgcacgaggagcggagagaggggtgtaggagtcatacctgcgatgcatcggtctcggactccgtcgtcggggcaaggcccatctatcagtgggggaggcctgctgggtttagtaggggcccgacctttcttccattttttcttccagcccatgccttaagtcagacgtcggttggaagctccttcgtctgcgcgcatgtatttgtacgcgcactccagcaattcggcgtatgtccggaggagggtcttatccaaggagtatgtaaatcgggacctccttagccccctcttcatggctaagatagccatgtcctcgttgaggtctcaaacctcaagcgtggccgtgttgaatcgcgtcacgaagtatcggagcgtcttgttttctccctgtttgaaaaaaaaagactgtcggaggttcatggaggcttccgactggtgctgaaatgggccacgaaagtatgttcgagctgtccgaaggagtggatgcttcctgagcggaggccgaagtaccaggccctggtggccttgtgaagtgtggcggaaaagccgatgcagagaagggcattagtcgccccttggatcgtcatgagagccttgtagctctccagatgatcaactgggtcggtggagccatcgtagggctccacatgaggcatcttaaaccgactagggatcggctcatcgaggatgagtcgggagagaggttgggcggtctgaaagtcgacgtcgttcgaggacttctgtccgtccacctgcagctgggcaagctgatggttgatttcttcgaacctgcattcctagtcatcggcccgtcggtgctaagagaccccgggggtggagtctcccgatgaatctgagagggaggcggacggtgttcgcggtcgcttctccttccttgctcgttccagctgggaaggagatggtcgtcgggatcggtgggcatcatgttgtgtccgccttccccccctcggtggaagtgccgtgacgactgctcctagggaggggatggagaccggcacaggcatcggcggctgctcctggagggcatcgggtgtgccgtcggttgctccgccggtgagtgtggcaactgggttggttgctgttgaaggctcttgaccgcatccgtcagcacggtcatctgccgcacgatcgtcgcgaactgcacctccgtggtcaccacaggatgtggagagctaggttccatcatggagggtggaggagaggcctcttcccgatgggaagagtgcctcgccgatccggtggccctcgatcgctgagccctggttcttatcatttcaaaagggtgtttcaagttctgtgggggtcgtaatccctacgttcctccatggtgcaccaaatctgttgtggccaatctcctcgtcgcctgatcatcggaaacgagtgcctgcaaaagaagtccgcactgatcggaggtgactccggtggggaccttccgatggtcaagtcagagaggagactaggcaacagtagaaaagaatcaaggagctcagcaagggggagagagagagggtaagcccaagggtttcgaaagaacctcttccagcactgttgccttctccgttttatagtagagcgcggcatgacgccgtcattaatggcacagacaatgagagagttgtcaaatcatcggaggctgtcagagtcaccatggggttgtcaaatcactgtggggctgtcagagtcaccgtaggactgtcaaatcactagggttgactcatgtcttgggtgggacgatgtcccagggcggctacgccgcatgcctttgtcaagacagcggccctcaacagtcgtacgatgtttgagagagctgaccgaccatacattggtattcgactgtcgggacatcgagtgatgatccggaggcaccgtcggttggtttggtgccttgcttaagtcggacgtcggctgccacccccgacggtgagtcggtaatatgggttcgaccgctcagtcagtcggaaacaacatgggtcggttcgaccgacactcctttggtcggataatatcgacagctactatcggcagtcgtcgatcggtgcggtcagtagagttggacgtccgtcggagtcgtccgtcggtcgtcgatcagatcggtccgagagtaagtcggcgtatgggggtcagtcggtatatcccaataacctctaagataatagaaaaaggtctcggctaggctgtgctaaggagacaccccaggattgattgagaccttcgaaaaagcctcagcttgactgatcagaggagtcatcctaggattgactgaaacttttaagataaaaagaagtcttcgtatgaccaagctaaggggacactgtaagaaaattttttttaccaaccgttattagcgatgacaattttatcatcctaataatattttttattgataataaatggtgaccaacaaatttattattgcaaaaaaaaatagtgatggtatttttgatttttaatgacagctaattacgtcactaataaaaaataattttatttttttaatttgattcaagaattattagtgacagagttatcttattagcaatggtattttaccgtcactaataaccttaaatttttccctctgatccctctctcccgccccttggttctcacgatttttatctaattgtgtgccccaattttccccacccccctctcattttttcccaccagcattcgactccctcccctcaatttcaccctccccgagcatccaaatcctatttttctccatcgacggccgactgactgctggattccacttccccaagccccgactgcctcctcgagcccccgtccaccgaatccaagcccctcggccacctcccgactcctcgaatcctggccgcctccaatctccctctttcccccaccgtcggatcgaatttcttcgagccttcagctgcctctccgagcccctgtctgtcagatcgaaagttcctcgaccgcctcccagagcctcggccgcctccgatcccccacttcccccgtcgtcagatccggctttcccaagctgtcggccgcctcctcgagccccgaggcatcgacctgcctgtctgagccatcagactacctcctcgagccatcggaccatcgcccccgcctccccccttcgaacacccagccatttccatcaacctcatcggtcgttgcctcaccacgccacctcaccacaccacctcgtcgtgcagcccatgcccatcaaggacgtcggtcgccaccttgctatgcccagcaacctcgccgcctcgtcgtgctcatccatcagctacctaaggcagatcaccaccattcctccactcagtgccatcgacatcccctcctttccatctcgatcgcctcaccgtcgatcaaccatcgtcgatcgcctcaccgctactctcttcttctcggacagccactattactcaccaccgttagccaccatcggctcctttgcctactgcaatagtgctaccaagagccgctgcccttcccctcacttggtagatctaaacatgctggccttgtaaatttgtagttttgattgatgtgctgtacatgggcttttttagtttatatctagtattttttttttaattaactttcaactctcagcaaaataatttgatgtcaatgcttgcagaaattcaccaaatagttatatgactcgtatctaaacctatgtgctctatgaattctttctgacaatttgttaagttgctaatattctatcagtttgttaatgtaaagttgtagactataacaacatatatatccctgtattggtgtttgctttcatgcctatctaataaatgaatgtgcttgtacttgtgtatatccatgattttaaaatatatatttcaaaattatctatgcctatttatattaattcatacttatattttctaaattatctttattttttaaaattggtcgaactgagagaagaaaccaggttaactcctctcaactttattaattatgaagtttatatattggcccatcaaaatttaacggtcattattagttgatttgtgttggatatgttatttagtacgtaaatatgctcttttgtgttcttactagaatctcgagatttgccatttttatgaactgaaaaaaattattaatttaagcattatgaaggttgccctagcactccaaacatctgttatgtagtggttaagttaaatttctaaaaattgattgtacattgcctcaaatgtattgttagtggcaaaagactttaatttatatgcccagaatattcagaaaaccttgatcttaaggttctagtgtttgctggtgtcaacaagctcgtgatgaagtttagctcaacaaaattgctcaatagctctttgaatgtactaggaattgaatctttgatgatagtttcaaagtttatttttctcttttgcaatctttcatgcaaattaacagaagaaattttgtagaagacactttaaataatgtatggtaattgatcatatgaagagcagctgttatctgctttgacttatattttccactcctaacagcaatgggagggttcaattgatgttcttggtttgcaagatcggaccacaggatgcttcaaattttttcacaagtactactttgtgcttttgcttcccttttcttgccattctaccatagtgtccagtagtttgtatgatttttctttttggtttcttctttccatagttctaaactatgtacctgaacaatagctatcggcatttaaggtcacttcaatgggtgcaaggttgaatttccattgatgctgctcggcagaccatggaatcccttatacaggtatttgaattttgctttatgtgtgaatgattttggcttcattattagtttcaaagtttatttttctcttttgtaatctttcatgcaaattaacagaagaaattttgtagaagacactttaaataatgtatggtaattgatcatatgaagagcagctgttatctgctttgacttatattttccactcctaacagcaatgggagggttcaattgatgttcttggtttgcaagatcggaccacaggatgcttcaaattttttcacaagtactactttgtgcttttgcttcccttttcttgccattctaccatagtgtccagtagtttgtatgatttttcttttttggtttcttctttccatagttctaaactatgtacctgaacaatagctttcggcatttaaggtcacttcaatgggtgcaaggttgaatttccattgatgctgctcggcagaccatggaatcccttatacaggtatttgaattttgctttatgtgtgaatgattttggcttcattattagtctctgagcaatgtgattgctttgtttggtttggtctgtttatttacttgtttgtctctgttcttttatgcaatttgtcggacaccttagattctatctatttatctaattcataaaagctaatttatcatttggtcaaaagcttttatgtcaaacaagatatatattccacctatttatctgacccacagccctacctccctccttcgaagccctagccatcggagcactacgttgtcagacccgcaatgtcagacccgcaccaccttgcaccgtgagtattaacaacggcaacggcaacgatgacggagccgtcgccatcaccatcgtcacaccccattttcatctttttaaattttaaatatttaaaattagatttatttgattattttaaattaataatattatcaaaattaataatattattaataatattatttaaattaatattattctcgagaggtgaaaccactctaggaagctctctagcgagagtagccctactgccttcaatggcaggggtttgatatcgaatcatcattggatcggctctgacccactcatctactctgacggcgatcggagtaactcggcaattgaattctagaccttaggcccggcccaaagcccaaaaaaaattttcggaccggactcaaggaggccaacatgatacctttaaagtttacagtgaaattagataggtttagtgtgaatgaagaaatgaaattgcaaacagttaaaaacatgtcttagttcctcagctcacgtgcgccatcatatcctcggtatccctacgccacttctccattgtcgtcatccacttatcggatttcctacgctttgtcccttcctggttccccagctcatgccctccccgtcttatcctcttctttgtatgcctccttctcctcctctatcgataaggtgaggcagctttggaaggtatgttattccgtagacaatcggtatgcagccatcgttagatggaaaggagaagaagacaatgcgggagggatcttttccctaggctggcttctaaatttttctctcctcctgctcttcttctctgcatccctctctccttcatcattctttattttctttccttttaacttttgataaattgggacttggaaactctctagtgctatcttctagaccttgaaagaaaattctgtgttgccataccaagctgctttgccagctgaaatttctctagtgctggtaagtctacccatttcccttgaatcatctgatttttttttttaaatcatctgaatcatttaacattctttatgatgtcttgatactctcagattcgaacaatatggagtcaccagtagctccacatttacatggagcagtgtccaactctcagagcaggtaagtttattaataattttttttacttattttaaatatttatatttagaagcttcacatgtttaagcttgagttcgaaaagaggatctagagagtaaaagtttaatctaatcatccaatcgatggatcggaagtgtctatagcttcgtatcattaaataaaatatgtagaaataatctgttcgaaaatcaaaatagtatatcgaaatatacatcttcttatcaacatatatgctttcatatcaaaatttattgataatattttatttatttttgttacaagatgctaggacatccagctctcatctaccagctactgaagaggatgtacaggagcaggaggaggatgatagtaaaggttcaaggtcagaccaccatcgaactgactctatcccgatggtgccagaattagatatttggggccgcacgcatgttacactgatgtattcaatgagtctatagccatggccgacaggcccgggtaatcttcaaaagtttcatcgtgatggggacagatcattgcaataattgatcttcaacgtgataaactctaatactttagatatttttttttatattattttatcttttattatttaatataatattctttatgatgtcttgatactctcaggttcagacgacagacgacataaggtcaccagtgaccccatagtcacatgaagcagcatccgactctcagagcaggtaagtctattaataatttttttacttattttaaatatctatatttagaagcttcacatatctaggcttgagtccgaaaaaagaatctagggataaaaatttaatctaaccattcaatcgatgggccgggagtgtttatatcttcgtatcatcgaatgaaatatgtagaaataatttattcgaaaattagagtagtatatcgaaatatatacctctgtatcgatatatacacttgcatatcaaaatttatttataggatactgagacatctggttctcatccttcagctactagagaggacgtatagaggtaggaggaggatgagaaggatgatgaggaggatcttacataatttttttttatatatatgtaattttgatacatataaaatagtataaatttataaaattatataatttatattttaatataatataattaattttatatttatgattatgttaaataattattattttatttataaaaaaatttaaaaatattattgcttgttaatatgaacagattttaaaatatttaattataaattttttaaaaaaattaaaaactattagcaacggtattagcgatgacatctatcgtcactaataatttttaaatttttattaaaaattaaaaataattaacaacggtagtagtaacgataaaggccgttgctaataattttttgatattttaattaaaaaaattaaaattattagagatgatttttgttgctaatatcgttgctaattatcattattagcaatgaagattttgccatcgctaataatgataattaacgatgaaattattttcattgaatttttagcagcggcattccatcgctaatgctattagtgacgataaactgacaattagtgacgacaattagccgtcgctaattgtcaatttttttgtagtgagataaccccaagattaactagagccttaaaaacaaataaaagtcccaactagactaagccaaagagatatcctaaaaatcaatccttgagattttcggacgaaaagtcctagcatagactcagctcggatcgaaggaggtatacttagcttgatctcttggtgctagctatccagaaaaatccaaccaattaattaaaaatagaatggacctgcaggattggttacttcgattggaacctcggacaaatattatggatcaaaactagatggccagtgaggactaaagtttgccatatcaatcccctttctctatgaaattttggctatattcttatgggatcctcattttattcttatagagatatggttatatctttatttgacatctacgaaagtatctagacttatctccaaaatatcttagttcagctaatttatttatcgcattctgatcatataacggtctacctttaaatgtcgttataccatatttcagcatatccctaaagtgcttatggctttgtcttattttaacagagattctagatttaacatagctcatattattttattatggcattatgggcttatatcgacatgtctccaagggcattatgattttatctcagtttacctccaaagattttctaaattattctgccgatctcaagcacttggagctatctcagcctatctctgaaatgattatgattttatcttgactttcttctcatcactcaattttgctcaactaacctcaaattcttggtgtctatctctaaagatgctctagcttaatttagctgaactcaacatccatgagatgacctcgagttgctaggacaaatagttaaacattcggacaatgaccaaaaaaagacatgcataaaaaatgattctattgcattaacatttataatttgttattacaaaatggaacaaagaccaaataagattccattacaaaagaagaaggtcaaaactagctagactttagttttaaaaggtcgatgactccaataagatcacctaactcaaaagcaacatcaggaagcacaagaagacctacagaggtctactcgaagcttgaaggctccccaacaccattcctggaagggctgaagctactgagattctataaatctgcaagacaacagatattaattagtatttctatatgttttgtcaacattgtatgttgacattccaaagtcatttcatagatcaaggtctcagaataacaagtacaccactggtgtatatatgggagaaatcaatttcataaagatgaacaatgtaaagctcttcggccaattggagtttggatattttaacaattactttatcttccatatctgctttcactattctaaccgcattctttgttagtctatgcattattattattatctatgcattattattatccatagaaatttgattgggaaagtcatgatcgaatatttttctatcatcagcggaaacaattttagcattgcacagcactgatgatacagaccaaaatgctttagaaaattaaaatacaatagcttaacaacctaagttcaacatagggagggagattgtcaatcgcatattgctttatgctcaaccactttagcagaggggcctttctaaaattttaaaagcatcttgttattgataaaagaaggaatactaagtagggggaaaggaacgaaaaataatgagattttttgtcgatggattgattacatattctctgatacataatatatatatagctttaaaatttaactatataataaatagataaaatagagtaacaaccaactctatcaaaataattttttcgtaatttattagattttggcacctcaaatttgacccacagcagcgaagtccacaacagcaaaacatagatggaaaagcccataggtgtgcaagcctgcaagcgtggctcatgggcgcgcaaggcccgcaagcatgtggcccacaagtgcacaggcccgcaggcgtgcatggccagtgcgtgtggcccaagcactcatgcgtggcccaaaagcatgggacgtgcggcctagaccgtggttcactgcacggttcatgcgcggtctatggcaccatgcaggaggtggacacgtagtccatgcgaggtctacacgtggttcacgcagtctacattgcttgcatggaccgcatggtccaaaggagttttatcgcggttcatggaatggatgtgcgcgatccaaaggtcgagatggtgtgcaggggtgatccaattgtggctggtgtcttggactcccattaggactttgtcaaggttttttaaaggtctttttaaaggcctaacagcatatggcaaggtaaagtaggatccgtgagcattctagtacggtagagaggcataggtagtggctgagagcgctcgaaaagagaggattcatggccgagagcatcataggaagcatccaggggcatcagatgaccttgatacgtcaggtctgtgaaagagtgtctttgaaaaattttgtgagagcttttgtaaggggttatacttcttgttgaaagaaattgacgtatcagaattgagagaatatgatctcctcatgtacttgttttctttaatagtgaagcttacatgcccatagagataagccttgagctgatctatgtatttgattgtattttttttatttttcttcttccttcttgttggggaattgacaccatcacctgagttagtgatcttaggcaggagatctatattccacaatcatgaaggatctttcccaataagtggtatcagagcatgtggttgtccagattgcgacagtattgatcgagattaaaaaagatggagaagacaggattaaataaggtggagatcaaccggtatgatggaaaggacaatttctccctatagcaagcggggttgaaggatgtgctcatccaacaagggttgattgatgctctcttgtatgaagagaagccgactaccatggaggagaatgattggaggtggctccaaatgtaagtggtgaatacgatctgcttgacttgacgaatgatgtggtgattcatgtacttagcgagacttctctaacagcgatgaaagttcaaggagatgtacatggtgaagtcacttaccaaaactctttttctttagaaacagttctaccagctacgaatgagcgagagacagagcatgaaggaacatctcagcaacgtcccaaagatcctcaccaatctcctcagtgttggcgagaagatgaaggagaagtcagggcattggtcttgctgtcatcactttctcgttcttttgaatctttgataactggtcttctaatagagaagagcaccatcagatggatgaagttacttctatatttcttcagaaggaggttctcagataggagaactgagcttcaagttcaggtggtgattcggctatggtggtgactagaggaggtagtggcagaggataaaggggtaaaagatcgtaagatggatggtccagatccaaatcaagggacgtcaacaagatcagatgctaccagtgtgatggagttggggcatcgaatcagaattaatccacagctcagagatcggacgaaggctactacagcgtggtccatagtagcgataatgatgagatcgatgatgtgcttatggtctcagatgaggtatctacttttttttcatagtagattttagattctgcatgtttgcatcatatttgttgcagagaaaagttgtttgattctctagagagcagcaagggtgctgttcttatgtcggatggatcgagctgtgtgatcaaggatattagaactgtcagcttatagagtcatgatagaatactaaaaaaattagacaagatttgatatatatccaattttagaaataatctaattttactgaatagattagatttaagtggctacaagtagagagctgaggatagaatcctgaaggtttggcatgacagtaggattgtgttaaagagaaagaggtatgaaggatattatctcttgacagagagctcaatgtgagatagagtttcaggagccagtgggagctcagaatgaggtggagctctagatacagatggattaggcacgagacgaaagacttcggaggataacaggtgatgtcgcatgatgaagtttctattatcgtaggaggctattctgagcagatcacaagtcagacagatcacaacatatgatggagatgggattaagcggtctagctcgaatttcatatttgtccattaataagtagtcagatatttatcctagggcatgagagcaagattatccaaaaagctcttagagttagatagagaccgaatgtcgaatcgagatggagattgttagattttggcacctaaaatttgacccacagtagcaaagcccagatggaggagcttgcaggggcgcagggtgcaggcgcggcccataggcgtgcaaggaccacagacgcgtaggcccacaagcatccaaggctagcatgcatggcccgtagtaggcggcccaagcacgcacgcatggcccaaaggcgcgggatgcatggcccagaccacatttcatcgcatggttcacatgcagtctatggtgccacatgggaggttgttgctccatgaattgattttgatgattataaaatatttgaggaggtttctaataattttggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactcaagttggtgcttgactagccgagggatagtctacaaatcgatcttcacttttcaatgggtcaaactacacctattgaaaaactcggatgaaaatttttattcaagcacttaactatgatatgtggagtatcatagttaatggaccacacacacctactaagataattgatggtatagaatcaaccaaatccgaaagagaatggaatgaggttaacaaaaaaataactcaactcaatgctaaagttatgaatgttttatattgtgctttagatgctaatgaatttaatcgcatttcaatatgtatgtcggctaagaaaatatgagatagattagaagtaacacatgaaggcactaatcaagttaagaaactgtcctttatttgttatgaatgtaagaagtcagggtactttaggttcgaatgtccacaacttaagaaggatcccaagaagtacaagaaaaagactatgatggctacatgaagtgatagtgatgagtcaagctctgaagaaaaagaagattcatatgaacaagccaactcgtgccttatggcatataaaaatgaggtaaatactgaaactcttaatgactttatttttgaagaactttaagaagcattttatgatctagttgatgatttaaagaagttagggataaagaacaaagaattaaaatcaaagaatcaatctttactaaaagaaaatgagattatttcaaataaaaaattggtcttgatacaaaaaaatctgaacttgaaaaataaaattgttaagttaaaatctatgatagaaaagttcactcaaaattcaaataaacttcaaatgatacttgataatcaaaaggccatttatgataaagtcgatcttgactacaaccctttaaagaaataaaaatttttgaaaaatatctttgtgaactcatcaagcaacaagtttttaaatattacttactttaaatgtagtaaagtaggacacaaatcatatacatgtttctctagcaaatctgaaaattctaatgtgaagaaaatatgggttccaaaagaaactattgtgactaatcaaaaatgactcaagaaaatttgggtacctaaagtcaaaacttgatttttgtatataggtgtgtcttacatcccaagaaataaattgaaaatgatatcttgatagcgggtgctcaaggcacatgaccgatgatgaatcttaattcatcacacatgatgcaaaagatggagggatggtcatttttggagataatagcaaagaaaagatcatcggtataagtaacattggtatgactccctctaagtatattaaaaatattttattagtagatggtttgaaacataatctattaagcattagtcaattttgtgataaagagtacaaagttatttttgaatctttattttgcatagtaattagtcccaatgatgaaggcattaaatttgttgggcatagacatggtaatgtttatatgatagatttgaatgatcttttcaagataaacatgcaatgtctagtagtcttgaatgccaaaattaatgagactagttggttttggcaccgtaggcttgcacatattagtatgcattcacttttaaaacttattaaaaaagaattgattatcggtttacctaaattaaattttaaaaaagataaaatttatgaggcatgccaactaggtaaacaaacaaaagtctcattcaaatttaaaaatattgtttcaacttctaggccattagaattattgtacatggatttatttggacccactagaactactagtttaggtgaaaaatgatttgactttgtcattattgatgatttctctcattttatataagcttttttttggcatataaggatgaaactttttatgtgttctcaaaattttatcgaaaagttactaatgaaaaaaattttttaattcaaaatattcaaagtgatcatggaaccaaatttaaaaatcaagaatttaaaaaattttgtgatgaaaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccatcagcttaagtatctttctgatttcaagttctttttgataaaaatttattgaaccaaattttgaactcaattctcatctcttctttcttaaaaactctaaattatcattcatatgatcaatctcttaaatagacaccctttactcaagttttaaattttttcaaaatttttttatcatttttttgaatttttctagccatgaatcgatcctaagataaacttgtaattttcattaaaatccatcggacactcttttttttgaaaaatctccgttagttaagcaggctgaccctttgtctttcatcttcctcatcccatcgaataaaaattccctccatctccactctctcaatcgcaaaaaaaattctcttaaagtctctcttcccatcgggttttccccttcaatcgtccttttagaaactaaatccattttcttttttttcttcgtttggacggatcaagcttaccctagcttcaaaccctcttctccaaaccgatggtctatctctccaaaatctttatttttcttctaaaatccttttcactctacctctcattaggtcttctaagctgtttgcaagtctctcttgtctgaaatggctcccaaattgaaactaccgcagagaaaaaaatctgctcgtgggttagagaaggaagtgtgcagaaaaaagatggcagccgagtcctctcctactccaaccccactttcagatcctgctctagctttttcacagtccccacttagtccaagcaaggtaccactctccaatcgaaaagtagaacttggaaagaatatagattttaaattttttaaaaaagaaggattctcaattggatcaaaattaaaagtcaaggatgaaaattttactgtctattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaacagtaaagtctttagtgaaaggtgttaacattgttcttgatccattacttttgggataaatcttgcacttgccttgtgaatgttatactcatatggagctcccaatcaaagaagagggactaaatattattttaggaagagcatttactaaaaatttaaataaattagaagcaaggatactttcagtaaagatgagacttttgcatcacatgatgatcaaactttttatccctaggagtggtaggtatgacctcttatctggtagggatatatgcatcatataccatgtgatcaccgagacccccttgaaccttcctactctgatgtttgaggctatgagggagatcctaaataggtctaaggctcacctgccttatggtatggcactcaccctgatctttaggaggttcagagtctattttgaagggaaggcagtcaccagattatcacattctgacaccatcaaccgtcacacactgcaccatatgagtttttcaaagactgatggcggttggtcgaagggtgttgaggagagagcagaggaggagaaaatatcttcacctcctcgtgatcacagagcatctgctgatattcagttcgtgtttgatcacgagactggtccctcagagtcagtgaggagggatgcttctgtaccacagtcagggagtagagtagatccttcagatatcagacttgcagatgatcagattgagttgaattttcagcgtgttgcttctattttatcccagtagtttgccacctcagattttgctcagaagatgacatcttaggctgtttcagatcagattataatccctcatgtctctactatctttcagatgcttacagctcagtctgcacgacttgagtagcttgagggatatattctgagactgacggatagagttttagatttacagaggcaggtattagccttagcccatctccaaccgtaagagaacatcatggaggtctccaacctgtctacagaggcggctaggcttcgtggcattttggagagtagttttgatttcttaaggagagagtttagggactccaatgaggctgtctctactcagattggtaccatgatgcagtccatgtcgagagttttgaaataattggacatcatcagacttgctctcctaacacaacacatatcttcccaggctccaagaccttcttgtccttctgctcgtgccggtacttctacctgtggccaaggcagatgtggtcgaggatgtgcccgtggctttgatcttgagtctcttcatcatatctttgactcttctgattctgacacctctagccatgatatttattagatctagcattgttaatcttttatgtctaggatctaacttattgcctttgtatttgttggctgattgactcatggatagttgtattttttttgttatacttgacttttgtatggcctatgtattttaacttgactcttatgtattgtgacacttacgtatctgataactcttcagtcatattttggatatatatatatatatatatatatatatatatatatatatatatatatatattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgtgattctaaattaactttaaaatttcaaaaatccaattcaccccctctcctcttaggttgcatagctgggtaacagaggtggatgtgcggtccatgcatggtttcatgaggtccacaccgctcacatggatcgcatggtccaaaggagttttatcacgattcatagcatggatgtacgtaatccaaaggttgagatggcatgcgggggtgatccaacagtggctggtgtcttggactcctatcaggataatgttaggattttttaaaggcctaacagcctgtggcgagtcagagtaggatctatgagcatcctggtgtggaagagaggcatagataacagctaagagtatctgagagaagaggattcatcgttgagagcatcatagaaagcatccaggggcatcagaggatcctgatatggtaggcctgtgagaaagtctctttgaaaagttttgtaagagcttttgtaaagagttatgctttttattgagagaaattaatgtatgagagttgagagggtgtgatcttctcctgtacttgttttctttcatagtgaagcttgcatgccccatggagataagccttggactaatccacgtatttgatcatgttctttttatttttcttctttctttctgttataatatcaataccatcatctgagttagcgatcttggacaggggatctgtattccacacttctgaaggatccttcccaacataattatctatccaaaactatccaactaaaatttttaattcaaaattaagtttatctttttaacatcctcctttaaactaaatttcttttatcaatgattccaagtgaatcctttaatttgcaaaatacttcaaaattaagggactttatgaaaatatctataatttgttctctggacttgatgtactccaattctatctccttctttttgacttggtcttgaataaaataaaagcgtacatcaatgtacttgctttgttcatgatagacaagattcttggctagtgcaatcgtcaagttattgtcaacacagattctgatagcattaccttgcggttgttatattgccttcaaaagatttcataaccatatggcatggcatgcacatgaagaggctgcaatatattcagcttcacatgttgaaagcaccactattgattatttcttcaaaatccatgtaaatacggtgtcacgcaaacaaaatatgaatccaatcgtgcttttttgatcttctagatctccaccccaatcattgtctaagtcacaaactaaataaaaatcattaaaaatcaaatagaaagatccatgattgagagtacatttaatgtagcgcataatccattttgcaacctttaaatgtattgactttggctcctccgtgaagtgactaattagtcaaatactatataagatgtccgaccttatgtatgtcaagtacctcaagctcccaatgagacttttgaaatatatcgagtcgattgtcgctccatcatcatgctttgataatttggtcccatattcaatcactgtacaaactgacttgcaatcctctatcttgaatcttttgagtatcccctttgcatagactttctgagatataaaaatatccttcttactttgcatgacttcaatcctaagaaagtatgacataaggccattgttcgtcatctcaaactcctgaatcatggcctgctttaattctttgaacatcacagattgttatatataaaaatcaaattatctacatataaagagattagtaaaatatcctctccattttttattagatttcatgtaaaggatgctttcatagaagcactggatgtagccattttttttgaagtatgtatcgattcttacattccatgcccttagtgcttgttttagactatacaataccttgtttaatttgtagacctttgattcatatcctttatcacataatctgtcggttgctctatatagacctcctcatcaatatagccattcagaaaatctgattttatgtccatttagaaaatcggccatttatattatgctgcaatagataaaattaagcgaataatcttcatatgaataatggggtcaaataccttattatagttaattcagacattctgtttgtatcctttagctactaatctggctttatatctctctactatatattttgcattcttcttcactttatacacccacttcacaccgatggctttttctcctttagaaagagtagtcaactcttatgtgtggtttttctcgatatggctttcatctcttcatctatggcatacttctatattttactttttatagcatcttcaaactcaatagactcataatctacaaagagacaaataaggtgtacttcatttgttacctcatatagttcttttaaacttcttatcttttatggtgctcttggattgccatttgatgatgaatccgatgaagtggacgatgatggtgtgggtgaaggtattggtgttgatgatggtgtagtagtggatgaagatttttcatcttcaatccaagcaggctcatctcctatgatctgatcgatcatgttgtgacaactccattcaccttcctcattaaactctacatctctactaatcataatttttgaattattaggatcaaataatttataagctttagatttagtgccatacgtgataaagatgagctttgagcttttatcctctagcttgactctcctctgcttcaaaatatgtgcaaagctatacatctgaagatcttcatgtgtgagatattttacttcttttccattcatgcttcttgtggggttttattctccaagcttgttgcaagacactggttcaaaatatagatggcgtaagctaccacctcggtccaaaacttctttggtaaatatttatttttaatcatgcttcgcactatattgagaatactgtggtttttcttctctactatgccattttgctaaagcgagtaaagagcagccagttgataccgaatcctattctccccacaaaatacttcaaatgaattgaaggtgaactcgccgcctcgatctaagcgaatgactttgatagaatagccgctctcattttcaacaatcaccatgaacttcttgaacatattaaaaatgtctgctttctctttcaaaaaatatactcaattttttttgtacagtcatcaataaaagttagaaaatattgatgcttatcaaataatatgaggacataggtccgtatacatctatgtcagtaagttcaagcagcttctttgctctgtatcttgcctcatgtgaaaagtatcttctaggttgtttgccaagaatacaaccttcgcacaattggtcaggatggctgatatgaggtaatccgtaaccatctgcttatttgatgacacattgagatcaccaaaattgagatgcccaagcctcaagtgccacaatcatgaggcatcttttacatagagtttcaagcacttggctacattatttttaatattaagaatgaatatcctgttctttgacttctctatttgggcaatcaagtcattaatattatttctcaagtaaggtttcttatctttcatatggatattataatcttttttaagtagttgtcccaaatttagaatattactattgagtggatgtctggccaggacaccacctctcaagacctcttcggtactgcacgatacagcaggaagaaagaagaaacaaaatagaaaataatcaaaatacgtggatcaaccacaaaaggactcgcctccacggggcatgcaaactttactacgaaaaaaaaattacaagaggagatctcaccctcagctctcgtacacccaatttctccctcacataaagttttttctcacaaaagctctctctcttaaaagaccccctgaatccctaaagcgaccattgttcgctgtccagaagcctcctgctccttctctcacagtgtcacacggctctctctcttctctcaggtctctgatcttcacgtcatacagaaaactcaagtcacggattctgttttcatgagaaaccaagccaaaaaagaccaccaccccttctgttcacagatcaggcccttttaaagggcttaaacctgaattagattaggtttaggagtcctaaaccaacccaattaagaccccaagctattggatcatgaccacaagccaccagagatgtctgatcatgatcgatccacaaaatagtatcgtggaccgcacaaaatgcatgggaaatgcccatgcagtccacagacccgaccgtggactgtccagtccactgtggatcggggtacaggccccaagtgcggggacctaggcctgggcaggcccgcacgtgnnnnnnnnnnnnnnnnnnnnggccacgcaccccacgtcgggccgcgccctcgtgcgcctggcccatgtgctgccacgcactgggcggcatcccaccgcctatggtcgcaccgctatcactccgtcggctcgccgctggccgtcggcggtcctccaccacctcaggttgcttgctgactttaaaagtatgtatcttctccgttcgagcttcgtttagggtgttcttgatcttattggacttcatttttcatcgcaaacctcgttgtggactcaatatggatcaaatctcgagatatcaaattctaacaatctctatctcgattcgatattcgacctcctcctaactcctagagcttctggatctcctcacccccataccctggggcaatcacctgctgatcatggataggcaaaaatgggagttgagccagaccgctcgatcccatctccatcatatgctatgctcctcttgacctgagacctactcaaggtatcgtcctacggtaataggaatcccaccttacgacgtcgcctctcattctcccgagtctcctgtctcgtatccgatccagctccacttacagctccatctcgctctcgaagctccacctggctcccgaagctctacctcgcattggacttcctgtcaggtaataatatcctttgctctccttcttcccctccagcataatcctatcaccacgtagcaccttcagaatttctccatcagctactgtcctgtagcctctcgaatccagtctgctcagtgagataagattccatctgaaattggatatgtatcggatctctcctaatcttctcactataccatcatgtgtcctccaactgaccattctaatacctctgatcgcatagctcgatctatccgacagatatacagtaccttcactattctcgaaagagtcaaactgctcctctctgcaacatacatgataggaacnnnnnnnnnnnnnnnnnnnnnnnnnnnnnnnnnnnnnnnnnnnnnctgaatcgctaccggccgtcgctacagcagccaccatccaatttttgagttgagagcaatctttggctagatgctccaactcctcacaccagtaacacctgattttgcttaagtccctcctggacttggaccgtcctcatcgcgatctcctgtcgctccgtctaccaccttctgctcctccaaaagccaccaaagttgagctactaccatctgagctcgaagctgggttctccctcctaagaacctcattctggagtatcgtcgtggtgacctcatccatcttgatggtgctcttctctactagaagagcagtcatcaaggactcgtatgaagatggaagtgacgttagcaaaaccagcaccctgatcttctcctcaacatcgtcatcaatgctgaggaggttggtgaggatcttctgaaagtggctgagatactcctgcatgctctgtccctcgaccatccgtagctgataaaactgcctccagaggaaaagagtgctggtgagagacttcaccatgtacaactcctcgagctttgatcaagcaccatcggggaagtctcgctcagcacatgaatcaccacctcatccgttaggtatatgcggatggtactcaccgcctgcatctgtagccatttccaatcccgcacctccatggtggttgacttctcctcgcacaagagagcatcaatcaacccctgttggatgagcacgtctttcacctttgcctgccacaaggagaaattactctttccatcaaacttgttaatctccatcttgattgttcctgtcttctctatcttcagtcttgctcaccaccgctgcaatctgcatccttgtaccaccttgctctaataccacttgttggatagatgtctggccaggacaccacctcccaagatcttttcggtactgcacgatgcagcaggaagaaagaagaaataaaataaaaaataatcaaaatatgtagatcagccacaaaagggtccacctccagggggcatgcaaaattcattatgaaaaaaaattttataagagaagatctcaccctcaactctcgtacatctaatttttttcttacagaaagtttttcctcacaaaagctctctctcttggaagatccctctgaacccctaaaacgatcgttgttcgctgttcagaagcctcatgctccttctctcacagcgtcatgcggctttctctcttctcttggatctctgatcttcacgtcatacgaaaaactcaagtcacgggttctgttcccggtgagaaaccaagccaaaaaagaccaccaccccttctgttcaccgatcaggcccttttaaagggcttaaatctgaattatattaggtttaggagtcctaaaccaactcaattaagacctcaaactgttggattatgaccgcaagccaccagagccatccgatcacgacctgtccacggaatagtaccgtggaccacacgaaacacgtggaaaatgcccatgcagtctacagacccgaccgtggaccgtccgatccacggtggatcggggtgtaggccccaggcacggcgcctgggcctaggccggcccgcacgcatgggcctgggccgtgcccgcgctcggcgcatgggcccatgccgcgcccccacgtgcacacgcgcttgggccgcacgccccacgccaggctgtgacctgcgtgcttggcccgtgcactgccgcacgctgggcggcgtcccaccgtctgcgaccgtcggcctcctcgtgccgactttaaaagtacgtatcttctcttttcgagctccgtttggggtgttcttgatcttgttggactctatttttcatcgtgaacctcgatgtgggctcaatatggatcgaatctcgaggcatcaaatcttaataattatttttcatcttcgaaagataatatacataaaaaataaattgatgattgttatctttgaggcagattagaatttacttttttctttcactggaacctttgaggaatttccaaaagagacttgtttttccaccgattcatctaattttgccaacatgcttctatgaccgcacatatgccccaccatccaagtaccaactttcttgtctattggcttcattttctttatagactaacaataataaaggatcctcttctattttttcaatataattaactacttctttaacttgattatttttattataaaaatactcaaaggaataatatttatattttttacaagtataacattgaatctcatatttatatctctgattttttgtatctgatctcccatatccaatattttgatttgctttatctctacctcgtcctcctcttccatggtcacggccatactcgtagtctctaccgtgaccttgacctctgccatggccttaatcgcttgggtttccatcattctttgagctttcctgtgcttcttttaatgagagcttcatttgaagagcatgttctactgctttctactttttttttcatgtgatgctcgtgggcttgcaatgatcccataagctcatccaccgatatcttttctaaatcttttgattcttcaatggctgcaataacataatcaaatttattatctaatgatcgtgaaacttttttaattattcgaatatcttccagcttctcgctattcctccaaagttggttcacgatggtcagaagtctggtgatatagtccaagatgctctcagattccttcatccgtaaggcttcaaattctccttgtagcttttagagatgaatttttttcatcatattaacgcttttgtaggccagaatctcccacactttcttggaagttgttgcatggagatcttctcaaattggcttcatcaatgccttggtagatgaggaaaagcaccttcttatccttcttccttaaatctcatagggtcttcatttgaatgctccaattttcataattctccttcatgagggatggtatttgaggttgcatgcatgccattcaccaaggggaaaggaatgggaccggaatgaaaaataagaagattttttatagatgaattgattacattttctccaatcaattatgtatacatagctagaaaatttaactaaataacaaataaataaaataaagcagcaaccaactttatcaaaataatctcttcatatttatctatccagaactatccaactaaaatttctaattcaaaattaagtttatcttttcaatggttattcacgaaccttaatgaagatggatgattagggccacgtaacatgaaaaataaagttttgagatctaaataaaaaaaaatttaagttacctctttaatcatttactataaaaggttatttatgcctttttgtatagtgtttgggtggtgagtttataactttacgtcatctattctctaaccggtgcccaagtagatacttgaacatcgcgcatgcttgagccagggttgtgcttttcttccaggtaaattcatttcgaggaaagaagcacaacttgcttagtcgagaaggtgaatcagatttgagcattgcttaacctcttcccaagaagtctgaaacttattttgtttgggttttttttagatcagcttggatatacctaatatataaagtatcaggtaggatgatatggatataaactatacaaacgcgctagtagactaaaagcttgaaagattagtaatttgcaaaggtgatggcatcaatattgtcataatgatctcatgctttagatatctactttcagagcggagacacaagatggttaggtaatagaaatttttttttcttttccttttttgaatgcaacaggtaacacactgacctttttttaaaaaaataaggaaaatggtgggagtcggctagtgaattggtaatgtgtaactgtgactgtctacgagacatttataacataagaaatagttaaaaaaatgaatgcagtaagtcggatggatttggcaaggtctattgttctatgggcttttaaagagtgagattcgatcctaggttttctttattttttttccctttcgggtaaaaatctcaggttcttttcttttgtttttttccccccaccttgaagaagagtggagtctatcgaaacaacattagtgatggttcaactcacatattcctcgaagccctaaaaaaaaaatcaactagttctggatccaattgcaaatgaacgcactggatctaaattgaagtccttgggagctaaatcactctcggtgaagaggaatccgattatctatgttgaacctattattatttaatcgttgaacctatcattatttaatcgtaatagataagacacgcctcttgttcttcaaatatggagaaataataaaaatgtaagaaaggtgcaagcagataaaacccaggttaggtggactacaaaaagttaggtgggtcttttctatgtttgaaaaaaaaaaaaatggtggggggagttaggtgggtcgacgagttatcaaggcgagggatccgtgtcaaaacggttggtaaaaccagcgtacatgctttaccaacaaccactttgatctccactttattgtttaatttaagtgtacgtaatgaggagaaaaagactttaaaacaggtagctaaaccatcattcccttgttcggcaaaacgtctgcttttactatatatgctgctttaaaaaaatatatgtagtttgtccatattaattttgctggtagaattactacattattcaatccctctaaaagaaacatttgataataatctgaaaattttggttgaaaagaagttgaagcatggctaaaatagaattcatataactgcccaatttggtggacgagttgtgtacgtttcttatgctacacttagtaatattttttttacatcttcaaagggaagtgtccctcaaaaaaagacaataaaaggaagtgatctccttttagaaccacttcaattattcgcctcgagccgttatatacaatcctttttcgttttactcttattctgtgatataatatggtacttcgtggcgtcattctgaacgtcacactcaggcgaggctgctcgtgcacgtgtagcttcccagcacccgtgcgaaccccgcgatctccttcaagcgtgcgagcgcggcctccacgttggtatccgacgcgttcccatccaaatccaacacgaagacgtagtcaaaccgcgcgatctcgcccgcctcctccctctcctcgactcggaccggcttcgaccggttgggccggtggtctacccgagcgacccggactccccggctctcgaagatccacatggcccggaagaggtccgagacccctcgctccagcgagaaggccaccgtggtcttatgattattattatcattatcatccagattaggttcactgacgacggctccggtcgagccggcgagtcccagctggaggaaccggttgaagttgccggcgaggtcctggaagttgttttcgaggacccgcagaccgaactcgtgggcggcgatctggctgccgatgacggcggtgtcggcgatgcggttttcagcgacgaagcgggcagcgtcggcggcgctggcgacctcctcgacttggaggtggagggcacggaggcggtccctgcagtggctgatagcttggggatggctgacgacgcggcggagggcggaccgcggggcgtgagggagggagaggaggcagtggttaacggggaggacgagctcgccaacgatacagacacggggatggcggaggaggaggtcaaggtttcgggggacggggccgtcgacggagttctcggccgggacgacagcgcggtccgcggcgccatcctcgagagcggcgaaggcctcctccatctcggagcaaggaatgatgagagccggcggctgctgccaggaggaggaagggggaaaggctttggcggcggcctcctggcagtaggagccccggccgccctggtaggccacgcggacaggggggcggccgccgtgatcgccggcgtcggcggcaggtggaggcgggtggcctcctggggcctggcgaaagaggcgttcgaggtcggcgatcgtgatctcgagacccagcttggaggccatgtcctcagcgatccgcagaggagatgatcgaggtggaggaggaggcctgatacggacgacgtcgtgtgtcctcctcctctttgtacttgtcgtgtgttgagactggatataacatgcggaagaagctttaaaaagcgcgaccatatttacgtttaggtagatagatagatagatagatatgatgacaacagagagagagaagcagagtggaatggttctaatttcgatctgatggatcgctcttctcctttgccgccgccttcttttttcttctttcgatcgccttcggtctgttggttggttcaacggagataggagtccaagctcgcaacgcaaccgcggaaagcggcagcagaggccaccgcgcagagatcgcgtgatgaaacgatccctggctaaaaaatgtgggagcgcgggggcggggtgtttatatctgctgcgatgatggggttgggtggtagatgaccacatgtcacacgtgagaaacagagaagggtgttaggtgggagcgcgtgcgtgcgtgctcgtgagggagataattgtgtgttcgattttgttttgtggtgtggaaggctgggacttgactagtgtatctgttcgttgatctattaaatttattaggtttgaagaagctaggaaagaagagccccgttgggtcagaggttgcatcatagtttgtacctaacccaaacgacaggtacctacgtaacgtgcatgcttctcttttggaatttacggctggtgaaatcagatcagctagtttataggagcccttatggccatgctatacatttcattcgttcagcatggatgatatgagaataaaacaaaaacatggaatgagtttatgaaatcaacaagatgtacgttttgaggcctgacaatgcactgcacggcgtgagctccttcgaaaaaaactgctgcttcgagtctccgatccgaggggagtgcagctgaggttggatgctgatcgggagccgaggcaccaaaagagaatttacaaaaagaatacatattcatcattgaaaatctatgattaaattaattagaatttaaaaataataataataaaaaaagaataggaaagagatgatattcttctcttagattgagcttatctcaagatttttttggcatctttttatgtaaaaatggagccacaagcagttagctagaatctattagatctaatttttgtgtttggtagctagcaatcaatccaaattgttggcaatttaaagaagccccatcagattatcacgtttggtataccttttggattggtaatctggattatcaggtaattcagatcacctcctatgagataatctggattgctaagggaagggatggctatccagattaccaccactttagtaatcttataaaaaaaattttggatgaaactaccctccctcctccccgtgtggcgtccttctcaacctcctctgccgcttcctcttcctcttccccgaaggcctcctccaccatcctcttccccggcggcctcctcctcaacctctccggtggagctggatgaggcaggagatgtccctggagacgtgaaccgagggtagggtgtgggcgaggaaagcgttccggggacaagggatgtggttatcgagccagatgtgttcgcgcatggcccccgaccgccaccacaggtggaggaactcccgacgctacggtcagagctgggcagagccgacgatgccgaagatgacatggcagaaggaaaacggcgtgcattgtcatcttccagggagggggagctaggagaagaggcactggcagtggagtcatgggtggtcggagggtagcacgggcggcacagacggtcggggggccggggtgcagtggccagggtagtgtgggcggtcgaggtacaatatcggaggtgcgacgggcgggtgcggatgtgtcaaagtgccaggaggcgatgcgggagagtgggaggaggcacggaaagccggggggggaggagggcgacgggaaggcnnnnnnnnnnnnnnnnnnnnggaaagccgggggggaggaggcacggaaggccgggggagggggcagggggggaggggtgtggcgtgtgagggaaggagaaggatgagaaaaaaaaataaaataatataataataataataataataataataagtattataaaatagtataaatttttttcatataataatttttatcattaaaaaaattaaataatagtttaaaatgctaaactaataatttgattcaagagtattttaaaagtttgatgttatattaccaataatctgattgtcataccaaatatgtcaatcaagattctcaataattttactataacattacctgcatataccaaacacagtaatcaacattactagtaatctatccagattgcaagtaatctaaattaccaggtaatccagattatcgttgcctgacaatgcaccaaacataatgttaggtcattaggtcacattttgatagattattgggatagaaaatttttctactaacctacaaatcaaaattgttaaacaattatggattttgcccatgtgggtagatgagcttgaagtctaaggtcgacatagagctgaggctccatactgatggctatatttgatgtcatctcccctcttatcagttgtggggcttcattttctatcttcggtgagatctaaccataggattggtaatgttccgaccataggctcatcgatatcggaactgaagtttggtaggaggccattgacaaagagtcggtccgtcttgttttcttgactctctccgatgttcgaggtaggctcgtcaagtcatcagtgagtgctcgattatgttctgaggagaggaaggttggttcagacagtaaattatcttcataacgtttatcccctactttcgagtccgaagtgatttcactgttttggacaaagaaaatagccaattttcaaaccaatctttgattgccaacctgacctccttggagcatttatcctacaatattcgatggaggaaatctcgaagtctttttaatgcatcgctttgtaatccatatcatatttatgagggatgagggcttgaggtactacatagaaataatttgaaaaaaagagatccggagatcattaatctcaaatctgtttggacttgccatgtgttaaatattgataggccccaccatgtggctcacaaattgtcttatgtggctcgatttggggatgatatgatgaagagtcgcaagatccgtcgcttctaatgttggccaagtggagagatccgacaggccaagtggagagatccaacaatttggtagttgaatttatactactagtagtatgtataaataggctatttcccattatcttcttttactttgttctaccaaattctctataatctatcatcgttgttgctagaggaaagcttttcccttgctgatattatcttcaccgacatcgatggctgccttgttcttcagttggtcctccatccctctccattcttgcttcttattttttttttgatttagcttccttcttcttcgcccctttttgagtcttctcctttttctttgctacttcagtctttccccatgatattcttttactattcatgtcttccgacggcaatgagttttggagtgaaaatccctatggcaaccacaatcgtaggccatcgcctccctagatccggtttgaggataattctcaggccattgttgtggctggctcctcatccagggactagatctccacatcccatagtgcaggtagtcctgtgtgcgagttcaaagatttctgcgattcaggtaacgaggagtcaaacattactcaagacaacccgcaaaaatttcggactcaattttcaatttcctcgactttctgactaaaaattttgaatcagaatgatcgagttaccaatgctccgaagggacaagtcgctttgtatgaggagtccctccaagccagtcttcatctccctctttaccttcattagtagtattttttgatttctatgggatccttctaacccagatcacccgaaactctacttgagtggttgtcattttcataattctttgtagttggcttcaaattcctttaaggtgctcacttttcatagcattatttatcttgaaattttcatgaaaaaggatgatggtacttctctccttgaatgaggtaaaagtttattataagactgtcctctttggtgcacggttggaagagccatttctttattgtctccttaaatcttccttggggcttcagttgggtctagggcgatccccatctttccccaaacaaagataatctattctgtccaaggacaagatagcttattagtgcctgcttgatgttgagatatcagaattgaaagagttgctaactaagcagaaccttgacaacattggtaccaatctagagttacctcggggtatgacgttctcctttatttaagaaaatttttttgattactactaaactaaccattttcctcctcgattttatagtgatgaggccaacccttgtatgtatcaaattggccctaaagaggcagtcaggctcctctggtggtgagccgtcatcaaagaaatcaaggatagaaatggcagtcaaacggatttttccgagtatctaacccattccaaatcctattaggatccatttagtatatcctaatagagtttgagatggatttgagatttaaaactaaaatccatttgggtttggaatgggtttaggatttaacccttgggtacccaccatccaaactcgtttatatataaataccaatataaaatcctaatcaacatttaagcttctctatcagccactccatgcttcccacccaattgagactcttgaggatggaaaaatagagggaaagccatgggaaaacaaaggaaatgtccaggaaaaccaagaaaaaaggaaaaaattgaaaggtaagatcttttcccacatggattgatcttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttnttnttnttgccttctttttttttcatttaagtttcttcctttggagatccatggaaaaggagagcacttgagggagatgggagtggtttcttagctcccgttaaggtttttctctagcatatgagattttgtgggatttgtggcggtgtgagttagtccctttaggttttgagagcctaatcctggtataaacatgatattttgtatgatttgggatatttttgatcgaaaggctccatgtctcccagctgattgaaactcatgaggatggaaaaatagaggaaaaatcatccatcgaaaaacatagaaaaatcaatgaaaaaggaaaaaagattaaaaggtaagacctttttccacatagattggtatttttttttggctttttcttcttttcatttcattctctattttggagatctggggggaaggagagatccaaaggaaggttggaggggtttttagattccagttgtggtagtttgagttggttccttgggtttttgagtgcttaatcttggtagaagcatgatactttgtaggatatggagatttttgatagaaatgatatattcttttttgattacaaaatttttgatttatagatctattgtcatgataatatgaataagaataaggattagtcggataggttcggatacctgatgggtatacaaatattaaatgggatagatttgggatttttatttaattttgtaatcgggtttgagatggattcaggtagaaagattttaaacagcttcgaaaatgggtagggcaaattttgtaggtatcctatccattgccatccctaaaggaagtcttaactgagaatttctactcctccagcctcagcaccatcttcaaggatgtcaagtactgacccaatggaaattgaagatgagctcacactggccatgcctttgcaatctgccccaccatcaagtgcgaagtccacccaagccctatcttatgttgaatggacaccatctttacctagtctatcttcatcgcccttatctctcattgcaccaggtaggccattaagatctgaggtggaccccacctcgtctgcgatcaaggaggaatttattatcttggagaatagagtgcagagagattattctactctttaaaatcatcagcttgcttgggagtagatgagaatgattcaattattaactgactagtcagaaaagaagacccatcctttggacgaggttattagcaatgcctaagccagtctctttggggtaagtttctaacttgcacttgtcttcgattttcatatgtgtagttactcaacttgtttctctgtacagttggggcatgacatctcagtccatagtgagagcttgattggtttcaaccaagtaaagctctcacttgaagagaagattcgggcttctgatgccaagtgaggattgcaaaggaggcccgatagacagtcgaagaagaagttttctaggccaagtccaagctgttggttgcctaggagaaatttgaagctttagaggacctagtgaggcactacagcaaaaggtggccgagcttgaaggagcattggagcttgatgcggcttcaatcaaggctactgaagatagggcaatgttggttgaggcttgagccgagaaggagagagcgaaggccatcactgaggcaaagcttaaggcaatcaaggagttcaagacttcaacaaagtttgaaaatgaggtcgttgagggctccttttttggcttgtaagtatggttttgaagcttacaagaggtgtttgacctgaaggcttcctaagttgggcctgggtgatcttcgtcccaagaaaagtaatgatgagggtgagccctcatcaattatcgggggtgaatctcccgcaaccgtcgagtctcctactatcgagccgaccattgaaggcatcgctatcggtcctgctaccgagcccattcccacaaaccttgattaatcttatatcttcttatctttatacttagtaaactcttgtaatgacttttctctttaatgtaatgaactttttttattggtcttgtggattcatttgacatggtcagcaatttgtccaattagcaagatttgttacttcgatcaacctcttgagttggttagagtatagaaattcttagacttgtctctcctgcaataatgtatgggatcggacagaagttgatttgaaatcaaaattttcattgtcaatttgtgacgatcttgccaagtcattattaccatcctcgacctctgctcgactcgtccatagatgaggagcgccaaatggccatgtagagttttcgaagggttagctcctttatagtcatcattagcctttgctcgattcattcatggataaggagcaccagatgccatatgggatctctagaggattagtccctttataatcatcatcgaccttcgctcgactcatctgtagatgaggagtgctatatggttatatggggtctcagagggttagttccttcatagttgtcatcagcctccactcaactcatccatagacaaagagtgctagatcgtcatatgggatcttcagaggattagtcccttcatagtcatcgcaagccttcgcttgactcatctgtggatgagaagcaccaaatagccatatgaggttctcaaaggattagcccttcatggtcatcatcggcctctgctcgactcatctgtggataaggagtgctaaatggccatacgaggtctctggaggattagtccctttgtaattatcatcagcctccacttgacccatctatgaacaaagagcgccagatagctatatggggtccctagagggttagctccttcatagttattgtcatcggttgattctaatgactccatttgtggtcagctagcatcgatatcagtcgagtattttcattttaataagaagtctgcattgatgctcagggaattaagaagtttttatcaatataatcagcgaacatacaatttactggtagtacaaaaacttcaaattctcgatgttccatgtcaaaggcataagagttacatcaaaactttcaatcctgtatgctccagcctgatgactttagcagttctgtaagggccttcccaatttagagctaacttatcctgctttataggcttcaacactacagcccaacggaggatgagatctctgggttggaacatcttcaatcaaatccaagcattataatagtggtctactcattattgatatgatgccattttgatctgagcttgcttcctagttttttcgaacaagttcaagttcatttgaagtcagcccgaattctcttactcatcatagtcctccaccctagtcatcagcattctaatctcaataagaatgatccgaaggtgaagttgaatggagtctctcctataaggatttaaggagtcatctgataagcccataataccttataaaatttttcgatctagagccctttggcttgattgagccttgatctcaatgtttacagatcacctcagccttaccatttgactgaggatgaccaagtgaagtgagcctatggtcaatattcagttcggagcagaatcctttgaacttctgattattaaactgtagcccatagtcaatgataatggctcgtggtagtccaaagcagcagataatggattctaaataaaatcctagaccttcttcttgataatttaagccaagggctcgacttctatttatttggtgaaatagtcgactgcaatgatcaaaaactttctctaaccagtggtcatcaggaacggcctgaggatgtcaatttctcacataacaaagggccaagggacaataattagtgcaagctccatagctggcctctgctagctattggcataattctggcactgccgtcggttgtatcctattgtagagtaggccaatagtactcttgttggattatcttgtaagccaatgacctaccctccaagtaattgtcatagattccttcatgaatctcccagagtacataatccactttgatcaatcacatacaccaaagtagaggtagtgaatatgattttttataaagtctctcttctaagtaaacactcttgggggcttggtgcttgatcctctgagtttcaacaggactggttagtaaggcaccgttaagaaggtagttgattagagggtccatttaactcggttcatggttgatctgtcggataattggttcttcctcgatgctcagtttctacaagtgttcaacaaagactcatatattgaggtcaagacatcccaaagtggcaagatgagataagacattggcttggatgttctctgaccttggtatatgttgtaccttctaattttagaaggcctctaagagttctttgatcttttgtaagtaccgagccatcttcgatcctcgagcctcatattcttctcaaatttattcgatgatgagttgcaagtcagtaaagtctcttagatcttttatcccgagttctttggcaatgttaaggcctatgagttgcttcatatttgaccttgttgttggaggcagtaaagtcgaatcaaagtgtctattccatcacgtcccctatcgggcttgcaaggatgagtctaaccccacatctttgaaaatttgaggctctatccacatgaaggatacaacataaggctcccacctctttggatagtttcgacgtcgactcctcatcaaatatagtacattccataagaaaatcagctagaacctaagcttttattgttgatataggatggtagtggacatcatattcttcgagctcgattgtccatttcaccatctaccccgaggtgtcgggtctttaaagaatagcctttaaaggttggtcagtcaaaacaatcattgaataggcttgaaaatatgatcagagtcattatgcagtggtgaccagtatatagattatcttctcgacctttgagtaccttttttctgcatcctggacaagcttgctagtgtagtaaatagatctttggtttctttcatcctcttgaaccatcacagagctaacagcaataggtgagaccgataagtgtaaatataaatcctcacttgtcaacagcttggagagcaatgaggatgatctgagatatcgtttgagctcttcaaatgtaatttggcatttcttcgaccactcgaaactcttcatttgcctgaggatattgaagaatggaaggtacttttttcgaccgacctcaaaatgaatcgattgagagcgaccatctagcctcctagctactgcacatcccctcttcattcttgggtactttattttcaggaatactctgatcttctctaggttcacctcaatccccatcagattaccataaatcctaaaaatttttttgatgtcacaccaaaagtgtacttactgaaattgagcttcatttagtttcacctcaacccaaccaatgcttcctccaaatcgatgatatgccgattagcttcagtacttttcactagcatgctgtcgatagaaatctccatgttgcatttcatctcgtgtttgaacactttattgatgagacactgatatgtagcttttatacttttcaacccaaaaggcatcatttgttagcaatacaaaatttaatcggttatgaatgccatcttctcctcatctttggaggccatttgaatctgattgtagtcggagaaagcattcatgaagctcaagagttgattgttgggaggatctctcatgagtgcggaatatgaatcttcatccaagatcgcaatgctagtgacgatgtcaatactacaagaggaagaaaaaagagagacaatcaaataacgtggattgactcaagacttatctccatggggtatacaaacttcactataaaaaaaataaatacaagaaaagattacatcctctcaactctcatatatcaatctctctctcaacaaaaagcacacaaaattctctcataaaactctcaactctcacaggaagatcctctcagctactatctctaagactctctgccgccacacatgatactcaagccgtctgcccccttttaaagcccttaagatcgtgttggcaatgcgtacacaagtcctgttaggattctaagtctaaaccgtgtctagaaccacctatagaccgcagtagaccaccatagacccctccacatgaatcgaagccatggaccagctcctcttcatgcgccacatgtgccacgctcaccctcgctcgtgtgcatcgtgacaaagaccatgcatcgtgcggtggaccatgtgaggaccgcatcgcccacatgtggaccgcaactcccgcactcttggacagcatggtggtccgtgcatctcgtgcagcctgggctgtgcctgtgggcctgcgtacctatgagcctgtgagcttgcgggccgcattcctgtgggcctatgttgtgggcttctccatcttggacttatctattatgggttttgctggtatcgatcgaattcgaggcatcaaaatctaataatctccatcttgactcgacattcggcctccacataactttgagagcttctggatgatcttatccccatatcctgggataaatacctgactgctcatggatggacaaacataagagttgaaccaggccgctcgatcccattttcttcatatactatgacctgcttgacctgagatctgctcgaggtagcatcctatggtaatagaaacttcattctgcaacatcgcttgtcatcctttcaagtcttccatttcgtgcccaatccatctatatctagagctccatctcgaactgagctcccactggcacctgaagctctacctcatgtcaagctctctatcaagaggtagtatcctccatacttctttttcttcataacaactctactgccatgcacaattttcaggattccatcatcaactctccatctctagctgcttgaatctagtctgcttagtgaaatcagattactcctaaaactaagtatgtgtcagatctcatccaacttgctcactgctccatcatatatctacaagctaactgttccaatatccttgatcgcacagcttaatttatctgacaaatgaatagtgatggcactactctctagggagttaaatagctctctctacaataaatatgatgcaaacatgctgaatctaaaatctactaagaaaaagaagtagatatcttatctaaaattagaagaacatcattatattcttcagtatcacaattttagaccactactgcagtagccttcatccgatccttgagctgtggataatctctgactcgatgccctaactgatcataccaatagcatttgatcttattgaagtctctcgacttggatctggaccgtctaccttgcgatcttctaccgcttcaacctctgccaccaccacctttagtcacttccaaagtcgagttgctatctgaatttgaagctcgattctctcatttgaagatcttattctaaaaaagtatagaagtgacctcatccatcttaatggtgctcttctccgtaagaagagcagtcaccaaagactcaaatgaagggagaagtgacgaaagcaagatgaacatcctgatcttctcctcaaccttctcaccaacactgaggagattagtgaggatcttctgtaagttgctgagatgctcctatatgctcagtccctcgctcatccacagctggtagaactgcttccaaaggaagaaaacattggtgagtcactttgctatatacatctcttcgagcttcatccacataaccattgaaaaagtctcaataagcacatggatcatcatattatttatcaagaataagtagatcgtactcaccacctgcatctagagctgcttcaaacttttatcctccatgatagtcgatttttcttcgcacaagagagtatcaatcaatccttattggatgagcacatccttcactctcgcttgctataggaagaaatgactcttcccatcataccgattgatctttatcttgattgagcatgtcttctctatcttctccaacctcaatcaacaccaccataatttggacagccacgtgctctgataccatttgtcggaaggaaccctcacaagtatggattatgaatctccacctaagatcgcaatgctgatgatgatgttgataccacaagaggaagaaagaagagagatataatcaaataatatagatcggctcaaggcttacctccatggggcattcaaacttcactatgagagaaataaatataataggagatcacaccctcttaactctcatacatcaatctctctctcaataagaagcacacaaaaaaactctcataaagctctcaactctcacaaaaagaccctatcagctactacccttgagactctctagccgctgcacataatacttagactgtttgcccccttttaaagccctcaagatcatgttggtaatgcatacacgagtcctatcaggattctaagtccaaactgtgtccagagccgcctatagaccaccgcagacccctctgcatgaactgaagccatggactaactcctttccatacaccacgtgctgcccaagcccccactcacgtgccctgcgacaaagaccatgcatcacccgatggaccgcatgaagaccgcacgtggaccgaatcaccatgcatcaaccatgactcccgccctcctagaccatgcggcggtccatgcatctcgtacatcttaggccatgcctatgggccgcacatgcctatgggccgcgcttgcaggcctacgtgcctgcgggtcatgctcctgtggttttgcactgtgggcttctccatcttgaacttatctactatgagttttactgctgtagatcgaatttgagataccaaaacccaatattgatatcatagagtgacatctataagttgatcgatccttagaatgaaaaagctatcctttggacaagccttattgagatcaatattgtcaatacaaattcgcaatttgcttctttaccattatgacattagcaattgactctgaagaatgggctttcgaataaatcccattgtcaggagtttgttaactttctcctcaattacttattgtcattctggggtgaagcttcttttcttttatcagacaagataatggttcaaatccatattcaacttatgaacaatgatatcgaaaggtacatctggcatgtctgatgctgatcaagcaaaaatattctcatgagtgcgtagtaatgccattgatcaatctctaaggttcggtgtcaattatgctccaagctaaatggttctgctcgaatcatcactgagtgaatttgcaacaagttgctcagttggttcacctcggacctctttcaactccttatggttttcaattgatagagcttccattggatgcttctcttttattatcaccaaaaaggattgacaagccagtatttgatcttctcatacttcaatgatcccattcctaatcgagaacctaacaagtaagtggtacatggagactatagctcgcaaggcatcaatctggattatccaaggatcgcattgtaagcagaggagactcgaataactaggaaagttagttgcacaatcttacttcaaggctcctgtctgacggtcatcgaaagagttatctcaccctctacagtcatggagtccctagagaatctaactagagaagtgttgacttttcttagtcgatcaatagacagtttcattctttgaaaactattgtaaaacaacacattaggtaagcttctattatcaattaatttttttttttacattatagtttgcaatcatcattgatatgatgatagcatcatcatgagtagtctgcaccccttacagttcattattagagaaagaaacaatatttccattcgctatctctttaccctctcaattgggccctctaccccctgccaccaacatagcatgaaattatatttataacactagccatgggttggttgatattatttttcttatcagattggtgttgctacgactcttcgggtgctcgatttcgtcactctcaagtatacttgttaagatagcatcttcagattaaggcctcaatatcatccttaagctagagatatttttcgatatatcatgatcatggtcatagtagaagcgacagtactttttcttgctcttcctctccagaaagtcctttatcggctcaggctattgaaaatatttctagccttcgatctctatcaggatctaggtccaaggagtggtcaaaggggtatagttgttgaactatcgaggaggacttctcgatcgatgattcttcgatggtcgggaggatttcttttctgctcaagtcgttcaaggatcctcctaacctcacttcttactgggagtctattttccttccgtttgcttccatgctgcttaggcttcttccatctgtatgtatttttagactcaggttagtaggtcagcataattttttgaaaaaaatttatcgagggagaagatgtggtactcattttgtaatcctcatttgagcactactatgctaccgacttgttgagattgcgcacctctagtgtggtagtattgaaacgtgcgatatagctacatagcgactcatcctcttcttactgatggagaagagactattggtagtttttagctgagctcgattactaccaaaatgagcaacgaacaaccttccaaactattcaaataattggatggactccaactggaatctcgaatatcatgtccgtattgactttttgaggatggtcgaggaggtaagacagaggaggatgtttgagatgccctatagcattatgagggtcctgtgatcctctaaatgattgaaggggtttgatgagccattataggctctacctaaggcattttgatccgactcaaaattggtttcctcagaatagcttgggagaaggggaaccaagagttgaaattgaggctgtcattattttagcaacaccactctagacctcgccaagccagagcttaatatcttggaccttctttttgatctcttcctctcatcgtgaccttctggatctgggagagtcgcctggtgtcgaatctccatcgaaggaagagagctatcgttggtcctcttccctcaagcttcgacgtgaggataatcgaggtgtaaaagtgggagcagagtagaggtgttgttgggaggtggattctgaacttttcaaatgaggtcgtcggttgtgtcaagatggagctacttgagtattcaactctggtcattgttattgctctgccacctattgaggccattgtacggcatagttagagtttggatctgacgaaccagggcatccaatggtagtgtattctgttgggaatagtgtttcaaagccaatcgtcagtctgttgacggttgtgctcattttttatatatgtacatgaattataaattaataaaaattattttagtatttttcatcataaaatatttcatcttctaatgaactcctatgttgtggtgaagtccttaggactatttagactcgacaaaggaggatttgtcatttagtccttaaatctgttcgcgatcaaatgatacgttgttaccaaggatgacaatatttatcaagcataggtcattgtgtaccatataggttggttgtcctcttaaccaatgagtgtggagacactgatatggcatacaggtgagatgtaagggtacatctgcactaaacgtgaccgactccagagctatttctgctgtcaaaatttgctctgatggaatatgggtataaatatccctccgatctgagaccgccacgatgacttgcaagcaactcactgtacttaggcactggactatctgaatttttaattcagtgatggaaggctgctgggtgcagtcaagtacttgacttgtcggtgcgtgtgtcaagatgggattgaccactctagtttaagagctgtgtacagtcatattttaatttagcaaaaccttggtcaggatagtctttgcgaggagtcacaggactgtttgagttgagcatgattcggatgatctaatcagggttgacagtttaaccctgagtcgtcctaaacacagaggtcaaaagatgaattatacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagaagcttcgtgtggacgatcagcagaggtcagacatgctgtgtagctatattatgatgatcagactctcctgacggtgatcagattgcggcgatctactacccgcacaaaggtattgtgttctgaacacattacaataaagtgtttactgttcaaattcgaatttcaaatttaaatgcatgcatgctatatatcatatttagattctaatgtaggataaatttttattaattaattagattaattaataattttcactgtaaaatagtgattttgaaaaagttttaaaattaccattttacccctgcactgattttccccacaaattcatcgtaataggaggccgtatagtggcagatccttgagcggtgttgctctagctatgatggaggattttcgatgagagatggtggaattatgtactctcgtctgtaccatgctctctttcctctttgaacatatttttatagccttttctttaatgcaaatttgttgcttcaagtcttcgatccgaggtagatgcggttgaggttggtgccaatttgaggccgacacatccaaagagaacctacaagagaagcccgtactcgctagaggatcccgataggggatcctctgatggttaagttaaccagagcttaacaacagtagagaaaatgagagagagagagagatgatattcttttatttgattaggtttatctcaggattctcttggcacttctttatataggggtggagtcataagttgttagtcagaatctgttaggtataatcttttagattgttaagctatattctgatagattgttaaggtagaaaatctttctactaatctgcaaatcaaaattgttaaatagttgtggattttgcccatgtgggtaaatgaactaatagtttgaggcataaaactgaggcaacggctatttctaagattctgagacatcgtcttccctctttaatagtggggctttattttccatctttcataagatccaactatagggctggtaagattctgaccataggctcagtcattatccgagctaaagatcgataggaggccaatgatagagaattggtccatcttgatttttcagctctcttcagggttcgagatagtcctgctgagccatcaattaagtacttggttgtgtttcgagagaaaagaaaggttgcttcatacggtagattgcctccgtaacaagtaggcagaggcccatgaaagacaagaagctgacgttggcagtgggggcggcgtccctccttctggggtaatgtcactggcatcttctccattatttatttatttatttatttttatttttatttttttgtgcgttagaaatcattgcattagtgagagtggtctcctgagatgaggaggttgcaggattctccatgacgtgaagtggaggtggtggagaagagaggaggatcaagattatgaagctacatgctctgataccatgaaatgttggggatgattgcagaccgtgcatgagaacctggtgattagccagcaactgaagataagagcacctagatacagaagcacaaacaatcaaaaacaagggcaatgccctagcttcgagaaaatgagagagaagaagagagttatttgggagaaagagcttttatttcttttttgtattcagcatacaataaatccttgacctagttatatgtatatatacctatacaaatagatcaagtccaaaactcaataaaactttcaaatagctaacccaatgtgatgcacttctcaagcccatgtacgctcatgtcttgccatgcactcactttttagacttaattctcgtccaaactatagattagctccttaagatcactctgaccaaagtcttaagtcatctaggatcaaactcgatcctagatccaaacagaatcccgaatagcttctatccaaaaactgagtcgactcatgctgagactgagtcggctcatctgaaactgagtcagttcaaactaaaactgagtcgactcacttgcatgttggcctcaagttctcgaaatcctactttttgtctgacttctcttttgagacatagtcgacccactctgagactagatcgactcaccttcaacttgattgatccagtctcaaaaatgagccaactaagcagtagaaatactctatcttgactggttcttctactggcttgcttccttgaccccttggcttcttctcttgagtttccaaggcttgggataacacacctgagctcacaatctccaccttgatgctcctaagcccttgtgaactcaactttattcttcagacctatccatgccacacatgtttgaaaactgtctcaagaaagtaccttcatgagtgtatctgactggttctcctttgtatggaccttcaccagctccacttcaccttcttccatcagctctttgattctgtggtacctcatgtctatatactttgtcctagcatgatagactaggttctatgccagctacagagtactctgactatcactgtacactgcaactgcgctctgttccatccccatttcagcaataagcctcttcaaccacaatgcttctttagaagcatctgtgatacctatgtactcaatctttgtggtagacaagactgtaatagattgaaggattgatcttcaagaaattggcccaccaaacatgcagaagaaataacctatggtagacctctttatatcaagattacctacaaagttagcatcaacaaacccttccaatggatctgagatctcccttaagatatttgagttcctcttaggtccatcttgctatccaaaaattagaccaaaccttcgagtttcctgaagataccgcaaaattcacttcaatgcctgccggtgctttttttttcgggtttgccatgtatctgctcacctggctcactgcatgtgttatatttggcctgcaacacaccatagcatacatcatgctgcccacagcactagcatataaaactctctccatatactctttctcttcctctatctgagggcactgctgctttgaaagagacatatagcttgtcaatggtgttccaaccagtttggccttcttcatcccaaacctctccaacaccttgctgatgtatcctccctgtgacaagtggagaatacccctgctcctatcccaacaaatctttatgccgagtatcttcctggtaagatccaaatccttcatctcaaattctacagacaatgcactttgcagctcattcactgcatctgcacttcttttggcattgagcatatcgtccacatgcagaagcaagtataatgcatcatcttcatctacatccttcacatatacgcaactatcatattcacatctagagaatccaagaatcaaaatgaaagtatcaaacctttcgtaccactgacagggtgactgcttcgagccatagaaagatttcttaagtaaacacatcttctccttcaatccagactgaatgaaatcatctggttgcttcatgtagatcctcacctttaggctcctatataagaatgccatcttcacatccatctgctccaactccatatcatgctaagctacaagcgacagcaacatccggattgaagcatgacgcactatcagaaagaataccttagtgtagtctacttcctctctctgagagtactctttggcaataaaccttgccttgaatctaactccatcttactctgaaggtgcctccttccatgtgaacacccacttagaaccaatagctcgagcacctcttggtagatccactagctgctatgtcttgatcttttccagtgactccatctcttctctcatggcctgtatccatgactcccgatctagactttccatggcctcctcaaacacctctggatctccattagtagtaatgagagcatatgaaattgtctcatcaataccatacctaagcgatctgtaaattatacgttggagcttgtgcaatgccactctcactagtgcattcctcccacctaatatctgtggctcctcctgcacctccatctgaatagctggctctccatgctgatcctccacttgagtaggacctcttctatctaactccaccttaattggtacactcctgtaggtggaagtagactacatgccttcagcctgtgattgagcaccactatccatctttacttttccagctcttcttgtactctccgatctctccaagatgctcttctcatcaaaaatgacatccctactgatcaccgacctctgtgcctgagaatcctacaatagataccctttgaatctctatggatacctgatgaatgtcatcttctgagactttgggtccaacttgcttcttttcagttgcctccacatgtgcataggctggataactaaaaaccctcaggtggccaagctccaccttcttttcactctagacctcctctggaatatctccattcagcttgcgataaagggacctgttaacaaaaaaatatgaaaaagctattgcagcaccccaaaaagactttgggagtgatgtctgtagcctcaaactccatgctttcttcatcagtgttcagttcatcctctctgcaacaccattctgttgagggatcatcttcactgtgtaatgatgtttgatactattctcctcacagtaccttttgaactctagacttgtgtattctcctccattatcagacctcaagcattttacttatcttcttatctctttttctacctcagctttctaggctctgaatcgggcaactacatctgatttttctctaatcagatatagccacatcttctttaagtagtcatcaataaatgtgatgaagaatcttgcctcacctctagctgataccggagctgatctccatacatctgagtgcaccaaatctagcactccttcactgtgcttggtacagttggcaaacttcaccctatgctgtttgctaaaaatgtatggctcacacaaatcattgccctccttcttcagggctgggattataccttatttgtttaactccatgagccctcggtcacttatgtgatccattcgatagtgtcatagtcgatacatcagctgctcctcctgtaccgctacaagcacttccctactatcattcaccactgagcttttcatctgatagagattattgctcggccttcttaccctcatcaccactaaaactcccttggtaatcttcaagcatccactccccagctgactactaaaagtatatccctgcttcttcaagtagtctaaagatatcaaattcttctttaactctggcacatacttgacattcgataatgtacgaatgaccccatcgtacatccttaccctaatagtgccaactttgaccaccttacaagggtgatcatcaccaaggctgacacctcctctatcgatctttatgtaagtagcaaactactcccgatgagatgtgtaatgatgtgagtatgctgaagtcaatgtccacataatatcacactctgtggatccatctgatacaaccagcagatcttcctcgctactcccagatgccgtatcatcatttttgctggcctttcccttctttgattttcaaagaggataattccttttcaagtgttcagtttgatgatacttgaaatattttcagacttttttctgatctcgagactttgatctatccttagattacccctgaccttctcctttggtcttccctgcctctcattcacagccaaaatctcagagttagaattttctttgcaaatctttttccgttgcttattagacttgagcactccaacaacctcttcatagtttaaggtctcatttctataaactaagattgttataagaccgtcatatgattctggaagagaacacagcaacaacaatgccctaatctcctcttctatcttcacatcgagactcatcatctctgaacagacttgattaaatctttgaatgtgagcaacaaggtctcctccttcggatgtcctcaaactgtacagctgtttcttcaaccatagcttatttgttatgttcttccccatatatgtattctccagtcttatccagagccctttgtagtagtctttgtatatacctcgggcaacacctgatcagccaagcacattcggatggtgctaaaagcaatttcttccaactccttccaatcctcagcattgatcctttccaatctctcccttatcaagaccgtgtagatcttttgctgaaccaccaaattctttaccctttgctgtcataggataaagtttttcttgccatcaaacttctcgaagtccaccttgaattcacttgaaactattaccacaatcaagcaaatctgcaatcctaacatccttctgcaatcacacaccaaaacaatcataataccttctctttcacttcttccacgtgcagaacctctccacctcaaccaagagatcactatgaagaagataaagaagagttttaggataaaacctgatgctgcagatcctggatgcaaaaaccctacacgccttctttctttcttccatgcaatcccactctgataccaattgctggggatgatcgtggactgtgcgtgggaacctagtgattcgccaataactaaagacaagagcacctaaatgtggaagcacaaacaatcaagaacaagggcaatgccctagcttcgagaaaacaagagagaagaagagagttctttgggagaaagagcttttatttcttttttgtattcagcatacaataaatccttgacctagttacatgtatatatacctatacaaaaaggttaagcccaaagctcaacaaaactttcaaatagctaacccaatgtgatgcactcttcaagcccatgtgcacctatgtcttgccatgcattcatcccttgaacttaattctagcccaaacaatggattagccccttaagacctctctgaccaaggccctagatccaaacagaatcctgaacagcatctgtccaaaaattgagtcgactcatgctaagactgagttgactcacctgagattgagttgactcacctacatgtcggcttcagatttttgaaatcctactttctgtctagcttctcttctaagatttagtcgatccattttgagactggatcaacttaccttcaacttagtcgatccagtctaaaaaatgagccgattaagcagaaacattctatcctgactgattcttctgttggttttctcctttgacctcttgatttcttctcatgtgttttcaaggcttgggagtgccacacctaaactcacataaaatgggtttaacttgagaaaggaaagagattttatttttttggatcatgttcatcctgtcgatgctattcacataatatagagatgatatggtgtttgttatctttagatacaatagacctgaataattataggatgaagttacaacaaaggagacctatctttaattaattattgttggtcagttgagtgccatctttattatcgagctggtgcttatcctcatcagtagtagtggacatgcatggtgggcggacgtgtgtgggcaatgagagtctgctatcaattctcactggggtactcacgagacatctctggagcttccatgcatctccgcttctcaagcaacacctcaccagcactcgttctagaaaattttcctagagacaatctacatcagccacttcatccgaatatatgatgacttgctgcacttacaattgttcacatagctcaagactgctttctccgatctcacacaccactgctcaaacgttctattaaacagcgtttgcatgccctcctctcattaatttgatcgctttctcatgatcacacacaccacggtcacacattctattgcacatcatgtgggtgttctattcttctttgttgcagcactagagctgtaaatgggtcaaattagaccgatatttcgattggattttaatattggatccagactcaatcttatagaaaagtagatcggatctacggccaagactttcgacctaatgagtcattcaattcgaatcggatccatatataatctagctctaatattaaaagttcaaatttggatcaaatcctgatcaaatatagctaattatattttagttaccataaagccaactattattaaccatgcaaaatagacaataaacaatgttgctctaaaaaaaaatatacaaataattttagaccaatctttttattaaaaatattgctcatactagtcttaaatcacagtttaaaggtttaaataggtttgaatcctaatggcatacctggtttgggtcgtgttggatccaaattcaataaatttaaaaaaatagaataaatctaattttagaatcgatctgaccctatagattctttaaaataaattgaattggatggattggatcagctaggatcctaagtcaatccaatccatttgcagccttacccacaaaccgttctatgccttcccgattagcgccctctgttcgctgcctgcaatctatgaatgccaccactcattgccgccactccaccgtaacataatcttgcactgttacagctaccttcacttctgcgggctactgaactacaaccagtatcatctgtgtcatcacagtctgggccatcgatccatagccagttttgccatggctccgcaccatgcaaccaccactccatccgtgcagcctctcaagttaaggcaccattctctagtctgtaactacctgagccattgaatcacaaccaccgtcgcaatgatatagggcacaccctcgacgaattattaggtatggttagtctaccacatcagctgtatgctagcccaataaaaactcaacatatgatactcctaactttgtctcctaaactactcttctaatcatggttacaaaaatttaaaaaaataattttgcttgaagctctatcattttgacgttgccagcagctgaagcccatctcctattcgtcttcgcatctcctcttcctcttcatctttttaccgtgaccctaatcttcttaatcttaattaaaactcaaatgaggaaaaaaaaaaaggttcactgacctatttcaagtacccacctcgtttatcaaaaaaaagtacccacctcccctggtgttgtcatcatcctggatccactcgatgaggtataccaatagaaagtcgacaacatcgaaggtctccaaagtttgaaggagagagaaattttttgtacaccgtaaacggtgtagaaatatgcatactgttcacgatgattgattcacccataaagccatagtgtaacgtataaaaaaaaaaaattatttcatcgatttcatgtgggaatcgatcatcacggatagtgtgtggggttctgcaccgctcctggtgcacaaaaatttcgcttggaggagaactagagttggtgtcatcggtgtcctaaatgatgggaccactatcaaagaaattattaagaaatgtcggctcctcagccacctttcgctccaaccgctgcatcactgtcccatcttcccaccccacccgccccctccggctctccaacgcccttcatgccatcacacgcgtcaagcccctcaacttcgataactcccacgcccttgatgcctttcatgccatcacccacattaagggctgctcgatcacccatgaattccatctcctcttctcctcaacccctcaccaccacaaggaaaatatgatcctatacagcataaaactgaaagccacccccagaaccaccccttgagaattggatcgactcatctatacatcaaagggtccaattttgcagaagggaaacttaaaactgaaacaaagaaaagtttggcctgcttgcagcaccaaccgcataccctcaaccatcccacccaaaatccaaaaaagaaaaaaaaaaatacaagactatccaacggcattagctagggaactaaatgaagagaattgaagggtctatcatcgccattatcatcttcatttccactctagattcaactctattcaaatcaagagatctagtagctctatttcttattacatgtctattcaatttttaagcaatatacagaacaatcatcaaggaatgctagtccgagaccgttcaaccccccaaacccctgcaccaacaaccacaacagtgagcatcgcggttccgacctccatccaaccaagaatttgaacctctccaccaggttctgagataatcactgcaagatcctcaatgtcttccttctcgtcgccaccattgatgccctcttcttcccaggtagcacaggtgacaccgccaccctcctcttgtttgaagagacctgcgccgccaccatcacccccttctgcattgtgtacgcccaaatctcctaaacttccatctcttcttctttcccagaattttctttaagattttggttggaggtgaagagagataggagatgcgaggatgaagcccaaaacacgaaaatgatggagcaaaattatttttgttattttcctaaccacggttgggagactagttttttttttttttttgatattacaaagaaaaaggctgtaactaattttaagagtactagcaaccatcttcaatcaccacaacattatactacctaactacaaatacacagcaaattaataccttcagagtcccacccccatcctgtctgcattcaacaaatattgaatatgagaggaactaggtgggatatgagttatagtaaaatcctcttctagagcttgtttgccagaaaatttgtaaccaaatatgcatccctgttaacataagaaatacggaaataagtccttgaggttttccatgcatgcatcaatatcctgtaacggagggatttggtactttttagtatgaagattgccaatccagttgataactgtaagagcatcgccttcaagccaaatcctatcaccctgaaggtagttcacaacataagaagtgcctagccaggcagcctagagttcagcagacactgaagtataccgaagtcttttgcctcttgctgccaccaattttcctatgcaatctctgatcatgaatctaccagccaccctcttcccattaactactgcaccaaaatttattttaacaacagaggagggggttgccccctcaaacaattagaagaaatagatgagttagaggctacaaatatagcaccccagggccttgatggagagttaaaacttgacacatcaaaaaatatagcaaaacattgcgtataaattcctcttaggagatctataggcctctgattgatttgttggaatactctttcattacgggccctccattgaccagccgcaatcgaagcaagaaaagctttgtgccaactctctaccataacaaacaccaccagaatattttgaccctcagaggcacattatgtctccaaacccatttaaactcaacattcatcatgaaggaggtgaaacaggacagtatcgtatacataccattgatactaatatggttaagattagaatatccccactatccctgatcaggccaagtaccataaagaaccgggatggtgctaatttgatgcatcatatcaaccggaaacatggaagatggcagttctatgttccaagtaggagtaaccggattctaaacgagcatatcattcatattttaatagataggccaagcacttaagaggcataagagaaaaccaaggctgcaaaaacacattgatagaagagccatctccaatagaccattaaaaaattaaactggatttttgatccaaaggcacagattttgttccagattgtagagcaactggagggatttttgtagttagaccaagaaccaatgaactggcacttggcacacacaactgaagcccataaggaactaggatgaagaatgatcttagcagcaagtttacagtgttgtctgccttcagagattgaatccccaatcccctatgatctttaggtagcccaaccgtttcctaggcaataagatgcaacccccttctatccgaaggatgaccccaaagggaggatttaaattgtttctccaaatcggtaataacaaatataggcaccggcacactatataaagagaataagggaactaagaacgatatagattgaagtagccctacgaggtaatgagagagttttctatttccaacttccgatttgggtagtcaccttatccaccaaaaaattaaaatctgttgatactagagttatacttggaatctgaatgccaagataagtccaaaccccctttttctctgatatcctccatatctttcgaatatgattttcaacagcacttgaaatggagcgactaaacttcaatttgtaacggttgataggttgccttgcaagcggacaatgtgcatcagtgatagctttcaatgctgtcacctctatgactgtagtcctggccactagaaggcaattgtcagcacaaaaaacatgggatgttgatgcgctccacgatatccgttcaagttctgtaataaattactttgaacaataatttttaagaaaatagataaggtatcaacatatcaaataaaaaaataaaaaggtaacgaaaatttttgacgagaccttctgatcggagttagctattgagaaaccattctattatggttaatcctctattacacccattgttgaagaacatttgtaaaaaaagttcatgctgatcgaaattatatccgacaaagattcttcgatgcttaagtcaacaaaaagtggtgaatagcagataaaattttcagagaggcagaatattagtccagaagtatcttaccaatactattgatttacctcctttttatagatgagttattggtaaccgtttgtaatggttagacatgtgggtttcacttattttgacattatgtaatcatggaatgaacggttatacccattattgatcatggtatgtggccattatgcgctttctgcactgacagtttttgatatactgactctacgttggtagtctgagtgtgtcgactgtatgtcggcaattgtagaaatccgaatgatcatcggtcggtaaatctgatttgtcgatggtcattgatcataaagtcggttaagtcaccatggttgaattgtatttgccagaaaagttgagaataaccgattattggtcggcctactgattgatagtcagtggtctatacctattaggccaaatgaaagtcagttgatgtgttgtaatggaggcggaactcgttttgggatatagctttgatggtttattgtctataaccgatagatatccgatcggccgactgtgatcggagaagcagactgaattatctcaacagttgctctccactcccaaatccaaagtggcccgacatgtagattggcatgtggcttgacacgttggacggatggagttgtcacgtgctatcttgagctctgatttaactgtaaacattaatgatttcttcgaaaaatgaagagtctccagccgttttgttgcttcgataaccatgagaccatcattgggatgtcgattcgagaagatgatttggcatctggagaatccgatcaatttgattctgactagttgatttcggccacgtatccggatgtcattggctctaaaccgttcacatagatagaggtgaggtgtcatgatctggcggtaggtgcgtcaaaccatccgatcgatggttgattttgatgcagccacatgtcgaaatctggagcagtcttgatttgaataatttcatcacgaccattgatgggccatatatatatataatatcactttcatttgaattttttatttttgtatttgtcatcttctcctgcaattgaggatttcgtcttggatgctgagagcttcaacatttttgaagtcctctttgtatttccacggtcttccaaatcatcccctagttccggggcatgttttttttctttcttttcttcttcttctaggtttcttttcctactattttcaatggctagtaagagcaggaaagataaagggaagattagaatagatgaggttcctcgagatagtcaatcgaaaaacccgattgacgattctctttcggatccggatatgaaagtttcttccttatctggatcccatgttgatcagcttcgaaaacatgcaatatcatatcccggagcaatttcaactttttgcatctgatctggatggtcggataagttctcctcctctgagtcaaatagcaatttatgtagaggaccttcaggctggtcttcattttttgattccgaagtttatccaaaatctccttgattattattctctgtcctactcagttggctccaaattctatttggttaatcattagttttgctttgttatatcgcttgatctcgaccaaccctcgatcttcacttttccgtgcttttttcattcttcgtctccatccaaaaaccaagggttggtggttcttcaacttaagaaaggatttatcttttatttttggtcttcctttgtccattcacgggtggaagaaccaatttttttttattttttcttcttcatcctaggacttttcttgtcttgtagagatccgagaataaatcccaacgaacatagtcggatcgatgttatcaatcgagagaacttttttcgactgaaagatatggaagtctccacataacaagagctactgatggagcaatctctctataacgctggacttagtctgatgacttctctaggtatagctgagtcggtcattcactttattttcatttatctttgaactttgtaactgaatctttttactttctgattacagctatgcgaccaatggtgcgaatctcgatggtcgatgtttgccaacatgttgctaagaagaaagcagtgatcgatgctggaccatcccgaataatgaagaagagtcgggttgttcggagtcgacatcgatgtaggagatcgacattccatcgatagtgatttccgatgctgagtcagttatcacactgtcagctccaacagtgcttcctccaatcgatgtaccatcgatcaaagtgaaattaaccagagatggtgatgtcgtggccatcatactggtagcggccaagatgacgccaatcatgttttcatcggcaggaggtcaagtcgagtctgctattgcggtcgaaccagaactatctgtcactgtactgactatacctcaagcaccttcaactgggccgatgctgtttcaagtgccattaacttctgacttcatgacagcttcgagcgaacgaccatcaactggagagcgagaaaaggcgccagctgtttctgtcgatgatggatcatcaacaagcttcaccgtgctttttgacatctggattcctacaagtgagtcagttttggccaatccaaaattggacaagcggctcatcgaggctacacttctctcgattgataaggagaatagaaaagatcagaccgtgtttgagatatttttgtcttcctacccaatgatactcgacgtaagttgatgatacttttctgatactcttctattttttgtttttgttttcaatctaacttgttttcttttcttttcagctagcacatgatatgtatgcattggagagtgagcatcgaaaaattatcgagtttcattgagcatggatggataaaactacagctacaaacatcgagaaggctactgctgttgaacccctctaggtgacaaccgaatgggagaaggcagtagttgagtgggagaaagagcttcaagagaaaatctcccatgctaaggtcaagttggagtcgaccagagccgaattagagtcagctcaatagaacattaagtccctgaagtctcgaaccaagaacaaaaagcactcaatcaaacggcttcgaagggagtgtgatggctgcatcgaggagctggagaatgaacggagaaggcatcaggccactgaggagagattggcactaaccgatgtagagtcggctttcgttgaggaagcacagtcggtgaaagatgctctcagtcgggctgtcgaggattacaaagaatcatcaaacttcaaaaataaaatcctcaagggcggctacttctcttactacgtcggttatgaagacggtaaggatgcagtcaaaaagctatatccaaattgggactttagcagcatcgttgcccttggttcggggaagagattgccgaggagattgcaccaactgaagaagttacaccagctgcaccagaatctgcttccattattgacaaagctgtaccagagtcaactattgccaaaggccatgaaatcggagctacgatggttatcgacatagctgaggaagaaactgactggcgatcggtgtagatatttttttttctttcttgtaatcggacaatagtccaacttttttttgtaatcagaccttgggtccgattttgtaatctttttttcaatgaatgaaaagataatttttttttctaaatatggagttccttttcagtcttgatgcacattgttgttgatgttattgaatatcagtcagattgctaattatcaatcggtgtgttgaatgtcgatcagtagtcatagtagaataatttgtctgctagtcggatatcacctgacttagattttaaataattttttttaaaatatttgatagacggtggcaagtcgaatattcttcgctgatcggagtgaagtcggtatacttcctactcgattggagcgagtcggcataatattccattctgccatagctgagtggcatattattctacttagccaaagccaagtcggcatgagtggtcattcgacttgagtcagtttctacagtggttcgatcgagatgtggttgatataaattgatcgatcatttatcgatctgatgtcatttttgtagataactgaatattctgagaatctcaatattttatttcaaatatgttgtatatataaacaactttactgatagtatattttcaaactatcgacatttcaactctgaggaatagtcattccattaagagtttctagtcgatacatatctagacaaagtatttcgatcaccttataaggtctttctcaatttagagattttttttttgatctaaagattttgaaacttctgtctttcttaagactaggtctcttggacggaagaccttcagcttgatctttgcattatagtatcaggccactctttgccaatatgctgccatccgaatttgagcttgctgtcgaacttcttggagtaagtctaggtcagcttttcaacattcaaaattacttggctcattatattggtcgactctcactgacagcaatccaatctcgagcaagattattacttctattccataggtcaaattaaatggcaattctcctattggtatatgtagagttgtccgatatacttagaagatcggatataatttttctatccagaggcttttagtttcattcaatctggccttaagaccatgtagaattattcgatttgtcactttcacttcatcgttagattatggatgaccgacataagtgagtttgtacgtaatgtgaagtttcacacaaaactttttgaagttttgactatcaaattatcgatcattatcggtgatgatggtgtgtggtaaatcgaatctacatatgattgatttctggataaagtctttcatcttattttcagtgatttgtgtcaaaggttcggcttccatccatttggtgaagtaatctacggcaaccactataaattttttctaaccagacatcgagaaaaatgaatcaagtatgtcgattctctattatacgaagggtcatggtgcaataattgatgtcagctgactggtcggttgatgttgtatgttggcatacttctgacatgatttatattttccaaaaaatttagctgcatctttctttatggtgggccaataatatccttatcgcaaaactttataagccaatgatttatcctcctaagtaatttccacaaattccttcgtaaacttttcggagtgcatagtcggcgtctataggtttcaagcactttagtaagggaagagagaatgaccttttataaagttattcattcatcaaaatatattatgaggccgtccaccttagtcgtttgatctctgaaagatctgtaggtaaagtttcatcagtcaagtattggatgatcggatccatccaacttggttcatcattaatttgtagcattttatcaattttatcaatactcgattgttcaagatatttaatgaacgtacggtcgaacgagctgaatgaggaagttgcgagtcgaaaaaatgcattagcttgagcattctctattttcgagatgtgagagatctcgaagtatttcaaggctgatgtaagatcttttactttctgaagatacatcataatagaatttcgggctccaaattcattcttgacctgtccgatgatcaattgtgagtcggtaaagactttcaaactatttatatcaagttctttagtaattttcaagctagctaaaagagtttcatacctagcttggttatttaagactttaaaattaaactcaagagcatactcagtcatgatccctttagaattagtaaggatgaagccgaccctactatcttgatcattggatactccatcaatatgtaacacccatatggataataagttggcatcgaaagtttcaatttattttgatttgccgtcaaatttatcctcaagattatcattggatacggtgcattcggtgataaaatcgatcaaaacttatgctttcattgatgatcatgggcgatattaaatatcaaacttactgagtttaattatccactttgccatccgaccagaggtattaagctaatataaaattgctctcaatggtcgatctgttaagacaactattggatgtgcctaaaagtatggtcgaagtcattgtgccgatatgatcagagcacagatcatcttatccactctcgaggattatactttgatattgtggagtactttgctagtataataaattgatcattgaattcgattttcatcctcctggatgagtaccgaactgactgtctttgccaagatcgtcaaatagagatataatgtttctcccaccttcaattttgtgagtaatgatggagatgctagatatttttttaaatcttcgaaagattgtcggtagtcatctgaccatgaaaaatctttcatttgtcacaaagtcttgaagaaggatagatacctttctatcgatcttgaaatgaatcgattgagtgcggcaatccttccattgagttgctgtatctctttctttgagctcagatgcttcatattaataatagtctttatttttttaggattagctacaatttttcattgtgatacaaaaaatttaaaaaaaaaattgactgtcactccaaatacacacttagtcagattcaattttatctggtatcgtcaaagtatatcgaaggtttcttctaagtctcaaatataatttgaagtttcaaaattttttaccaacatatcatcaatgtagacctttatgttacatttgatttgtgtcttgaacagtctgttgactagccgttgataagttgctccaatgacatcactttatagcagtagatgccattgtcggttataaaggcagtatgcttctcatcttcaggtgtcattcgaatttagttgtagcccgcgaaggcatctataaaacttaagagttgatgtcccgaagttgcatcaattagttgatcgatttttgataaagaaaagatgtttttcagacaaacttcatttaaattggtatagttgatgcagattttttatttttcattgatctttttcaccattactatattagcaagctaatctggatagttagcttctcttatgaagtcagtttcgaggagcttgtcaacttcttcatcgatgatcttctatctttcaggagcaaaagatcttttcttctatctcactagtctaactttgggatcaatattcaattaatgagttgttactttcgaaaaaattttaggcatatcgattgtcgatcaagtaaaaatgttggcatttgctcttagtaggttcactagttattttcactctggatcagataattgagatccaacttggaccatctttaagggatcatcttctcttaatgggatcgaaactagttgtttggctggttcactcatttcttcattttttttttgatccagtttatcaaccgacaaagaatcttcagattgattgttctttacagagatcataaagcagcatcggatcagttgttaatctccacacatttctccaacttaattttttatcgagaatcggatcaataaatggtatgttgatactattgctctcaagacattaagtcctgatcatccaagtatgacattgtaagctgaaagaactcggacgatcgtaaacgttaagagaatgatactttattatagatctattcttgtagttagtggaagagtattttttttttcacgatgactgcatctccagtaaaatcgactaatgacgtcgagatttttttgagtcggtcaattggtagttacattcgagagaaaatcgagtaaaacagaacatcattgaaacttttattatcaaccaagattttttttacatcataatttactatcatcatcgagatgacaacagcatcatcatggagagtctatattctccgaacatcatctttcgaaaaagagattatattgttgtcaagtcgttgcttctttatcaactcttctttgaaagttgccccctgatcctttgattgcctagaaatcatgttgataactttcgtcgttggctgattgttgatcgttttctcaggttgtggttgaggttgtcggtcagtgggaagttgaatcaggcagtcttgttagaattttttgaggtagccatgtcaaatcaggacctttattttatccctaagctgaatacattattcagtatcgtgaccgtgatcatgataaaaccgacaatacttttttttgtcgcagctcctcggtggtgctttcatcgatgggggatgatggaggtattcctctccctcaatctctattaggatctacacatgaagagcaaaaagaaaaatataggagtcatacctgctatcataattgttcgatcttggactccatcgatggagtgaagctcttttgttggttgttgatcgatttggttcgatcggagcttcatcttttttttgcttctttttttgatatttttttttgcttgacgttggtcagaagtatcctcattcatgtgaatatacttgtatgcacgctctagaagttcaacataaattcaagagagagttttatctagagaataaataaatctggatcccttcatacttcttttcagggccgagatggccatatcttcattaagatctttgatctcaggcatggtcacgttaaagtgagccacaaagtctcttagtatctatgtctcaccttgcttaatggagaagagactatctgatgttcgcagcatctttcgactgatgctgaagtggaccacgaacaaatgtttgagctgctcaaaaaaatttatgctccccggttggagcccagaataccagactcgagcagtctttcgaatagtagctgagaagctaatgcataggagagcatcgatcatcctctgaatcatcatgagagccttgtaactctccagatagtcaatcggattgatggagccatcatatggctctatctgcagcatcttgaattagaatgggatcggctcgttcaagatatactaagaaagaggttaagcatgtggaagccgaggtcgttggaggacttccagccttccacttggagtcggaggagttgacaatcgatctttttaaatttgtgctcgtaatcatcgagccgttgttgctggaaaaattcaggggcagtcacctgaagaacttaaggattgagaagtggaaggtgcacacggcctctttcccttcttgatgatatgtccacgagaaggagaaggagatcatcacgaatggtggatagcatggtaagaatgttgagaaagtggtggctcgatatgatgagaatgttgagacggttgtcattctggggatggagaaagagatcatcgtggaagacggcaactgtgcttggatggcattgaatgcaccgtcgacccctctgccagcggttactgctattgctgcatttattattgttggagactgtgtactatctctgtcaatacttttatttgctgtattaaagtagtaatttgaacgtctgcagtgactacaggatgtgaagaactaggctctgccattagagatagaagagggaggtcttcccggtgtgaagattgtcttgcggatcctatggagttattttgagctctagtttttaccataattttttgtaagccctccttcctggcgtgccaatctactgcagccaatcctttgttacacccattgtcagagaagaacacctgcaaaagaagtccacactaactgaaattatgtccgacaaagatctttcgatgcttaagttagtgaagagtagtgaacagcagataaaattttcaaagagagagtattagcctagaagtatcttaccaatactgttcatttacctcctttttatagataagttgttggtaaccatttgtaacggttaggcatgtggattctacttattttgacaatatgtgatcatggaatggacagttatactcactattgatcatggtatgtagccattatgtgctttctgtgccgatgatttttgatataccgactctacatcggtagctgagtgtgtcgactgtatatcagtaattataaaaatttgaatgactatcgatcaataactctgatataccgatggtcattgatcatgaagtcggttaagtcaccatggtttaattgtatttgccaggaaagttgagaatagctgactgttgatcggcttactgattgatagtcggtggtctgtgcctatcaagtcgattgaaaatcagatgatgtgttgtaattgaggtggaactcattctgagatgtagctttgatggtttatcatcaataatcgatagatatccgatcgaccgactgtgaattaaaaaagtagactgaattatcccaacacatcccattacatagaatagcaaattcagagttaattagaaagctcgatcccactgcatgaacttggaatgaaaacaaaattgtgtcataacaataaataaaaaaagccagtgaatcttgtcataggcctcctccatatatatctaatttcattaccattactagtttagaaagaggtactttgtgcagtgaatgcaatatttcataggcaaaaaaggatattctccataatgttttggccttgaacgaagactccttgttcaattgaaatgatagtcggcaccacgaatttgagtgttctcataaggactttttaatgacaatcttataaggagaattgcacaagccaattggtctataatctgtagctctttgggggttattatttttaggaataagaacaatagatgtttgtttccaagaagggagataagcatgctagaataggtcttgaatggctgagatgatttcatgcctaatgattcgctaaaattcttcataaaagaatactatagaacccattgggaccaggggctttttaggatgcttttcagcaagggttttctttatctcagattccgtaatgagtttaataagatctatattctgtttattagtaataacctaactagttagaggagtatcaataggcataatacccccatcctcaagccactaactttgaaaatgtcgcataaggacttgctggattaggtgttgatcttccaccttttctccatcctcattttttatagaatgaattttattagtccttcttctgataatggtagatctatggaaatattgagcattagcatccccttctcgtagctaagtgattttggatttttgtctttagaaagtctcttgttgtttaagggttttatgatatgcacgaagaaatgctaataggtgcaaatgctggtgatttgggaggccttcttgatttgctcccaaaacatgtagagcattgattttctcatggaagttttgttcttctctaaatatgttacctattatatgcttccaatgcataataactatacgggtactctgcagcataagggacaccttgacccccagaaagtgaggctcatgacagtgctaggcctgttgtatcagcctcctaataccttcgtaattaagccatattttttcaaatctaaaaggaatattgcccctagtcctttgatttgacaaagagagcaaaagagaacaaggatccaaagcgaatctagttagatggcccatagtggcttaagggaatagatccatccattgattggagggaaaacctccatcgatgcattcctaaacatgagccaaaccctacctattgttccaccaagtataattaggccctcaatagcctacattaatcaagtctctcagatgccccttctgttgggaatagtgtcccaaagccaattgttagcctgttgacagttgtgctccttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctatgtacagtcgtgtttcaatttatcaaaatcttggccagggtagtcctagtgaagagtcataggactaattgagttgagcacgattcggatgatctcatcagggttgacagtttaaccctgagtcttcctaaacacaggggtcaaaaggaatgaattatacggtaaccatattcacgtagattctgaatgttgcgattgcgactattcgatctatccgatcgtcgggtaccattgctagatggtcacttcgattagtacagaaattggttcctgtgctaccggcttaggttcgaacctgcggggtcacacacattagaggttcctttctgatctgatggctgattttgagtcttatgtatctgggactctatgattgagaattaagattctttgatcatgagttccacacattttggatactggggtcaaaattttgaatttcaaattttgaatttgaaatttgaactctttgatcagggtttcatatcgatggtctctgatgcctaatagcccatcggatttggattcaatatttatgagaggtttaattagtgatttgatcgctaattaactcaatttgattgagtaattatttttaaatgaagtccaattgaattggattcagtttggattgacctgattaggttaagtgttgatctaatcgctaaggtggcttagtccctgatttaatcagggattaagtttagttaatttttatttgttaaatttattgagcctnnnnnnnnnnnnnnnnnnnnctcttatgatgttttataaaatgagaaagggagggggcgtgggcaatgaaagaaataagaaataaggggcgtggggaggttctagaaaaattttgaagtgttcaaaatttaccgagaggagagaaaaggagagagaagtgggcgcagggtttttggtgtgtaccctagggtttctacttagggttcaggaagtgagattggtatgccacgagtgtcgtgagtccaccaaatttcagggagagatccatcagcctctcaaccaaccatgcagatgatccaaagcatccgaggagtcaggacatatcgatcgaaggagttcgatcaacatcagccatcaaaaggatgaaatcacgaactagcattcgtgaggagccgatcagacaggagctttgtgtggatgatccgcagaggccagacactagtgtggctgtgacgtgacgatcagagccccctgatagtgatcagattgcggtgatcgactacccgcaaaaggtgatgtgttctgaacacagtacagtaaaaagtttactgtttcaaatttgaatttcaaatttaaatgcatgctgttgtatcatatttagatcctagtgtagggttaattagtattaataatgagattaattaataattttactataaaataataattatgaaaaagttttaaaaattatcattttgcccctgcaatgaattttcgcttcaccttcaaccttaaaagatttatctctatttttatctccaacttggagtgtacaattgaaatctccaatgaggagactatactggcccaaagatagagaactgctttcgaagttttttacatttggcttgcatacaccacctcaagaatccaaggagccccattcacttgcgtgatgagagcaatggctacttaattttctgtgtgagcaatatttttgcaccgggcaataactataccactaagaagaccaacaatcgggatcatatgaattttcttgattgtacctataaacctctagatcctaagcagccaattactagatagtctaggttttaagaaataaacaacaaccaagctatgttgcctgattagagttttagcatagttgatagaaagggacttgacagcaccctagcaattccacacaataatcttcatagggataaagattaagttacacatggcatccctatagtcccttgaccattggtgtcagcttggtcctattaggaaatgttaagatgcacagcagaaaaataataataacttttcgattaagcatgtgagatctcatttcaaaataacatgaaaaatctaggtttctcataatttttaagattaagattaacaaaaaaaaaataagatcaaaatcatcatcattgcactaatagatattcaccgtgatctaataattatggatatcttcacgatccttttgaagctatacaagcacccaacttctataggtatccacacaaggttctgatttgatcaatgtctctgatctcattggggtgctagctctcttgtagagatccctcttatgatgatagatttttttttcttatttcttattattgaaaattcttttctagaattttaaatttcttctttttatgagattgcatgccgtgcctttttctcttattccttattgctcaaagtccttctcaaggattttaccttttctccacaccatgagattacacaccgcaatcttttctcttattctttagtgctgaaaatccttctcaaggatttcagcttttctcctcattgtgagattgcatgctgcacccctttagtgcgagaaaactcctccttttgtaacataaatttttttacatgagaatcttgagcatgaacagttaaatcttaagcatgaaggactcttgggcatcaacacttttagtatgtccaactcttaggcacatgagatgtgaggagataaatggagtgtcaagtctctttcacatgaaaaacttggggcatggactctcttgtatgctaaatctcatatagagagtgagaagtccttttgaacatcaaatactttgatgcatgtcaaatatttattaatggatcaatctttgattgatcaaaagactgttaggagtccaagtgctttgaggtttgatggcatcaactctttgatacgtccaacctttgacatatcaatcttttgatcaatcgagtcctatagtgattcaaaaagcacaatctaaccatcgatccgtcacaacctgttatgtgtgtgatctcataaattttattctatctgataatgagataaattatgatctttatccacaatatcattgaaatttttttcaatgaatagaaacaattctaactcatcctaataagaattatcgactatcaagataattctcgatcgtgaaagaaatgtcatctgatggtgattcttatgcatgctaattttcaaattttttatttatgtatatagcagaaaataattttagatttaaataatttaaatctaattagatctaatttaataagtatgcatagagatcatatcttatatctaagaatcattatataaacaacatttagatctgtcctattaaaatctataattttacttttgcacggatagatcttcatcgcaatctgaaaaatcatagatgtctctcgagattttttagagccgcacaagcgtccagcctctatatgtatccacacaaggctgatctcgatcagaagactccaaagatcaccaatgtgctagctttcttacagatctttcttccttcaaatcaaatctaatttcttcttcttttcttctcaagaaagagaaagaggatgataaactaagagatggaagagggtttctcttttgggcagcaacaagaaagaagaagtccttctatatgggtggcaaggaaaaagagagtggggcggcaaagagagaggctagatagatttcatcaattgcttagggcatcctctctaaggggtcctatttaattatagacctcaaattcttatccttccatgagataaatttgaatcaaattcagataacaaagatttgaatcaaattcaaatcttaaatcctatttggataaggaaataaggaggagagggaggaaagagaagcctagagggggtgcaccaacaccttggctgcgtcttctctctccctcttttcattacacgcatgccccatgaaggggggccatcggcccttgcttccatgtgattggcgctcctctttaggtgatgtctaagaagtgagagagtcccaatccaactgggaactcctctcttaatgcttttaaattggttctgaatcaattcagataaggtgaagccaaatcctatttggattaggaatagccccaagttgaatcaaattaaatataatttaatttattcaaagtccaatcattaattaaatgatcaaatcaaatgattaatgattaattcaataacaattgcttaatattcttccttgtaactcactaaccctttagtaagtccttttttgtaactttaacaaattggtctagtcatcaatcaaattgataactaagttcatctatgaatcaaatttataattagattatttaatcaagtcaaaatcttttttgtgtgtgatcccatagattttattctatctgatagtgagtcatatgatgatctccatcataaatatcattgaaatccatttcaatagattgaaacacttccaactcatcttatgcgaattattgactatcaattaattctcgtatgtctcacaatccatcagtgatacctaataacatatagtggcaacccaaaagaatgaaagagtctgaacctcttggtgtgttaacgtgtgattcagttcttttatcatgagttctgataagatggagatcatgaaaaactcgtcaaacctcatcatatatcatatataagatttaatcagctcaagttcaactcgtgatttttcataaaaatttctttccatcaatcacatcaccatggccatggtcttaagaactcagcttcataactcacataggactactccttaacttctaaaatcgatagatttcatctaggtgcacattctattcctacagcaaacctgttagatatgtgtcctaaaaactaattttgactgacacatatctttctctaggatatattctatacttgatgggcagtctttataaccaatcatgtcatttgtatccatgatttgtcttaaaaattaacaaagataattttgtatattctcaagatgttgagaatttgagacgtacatcattagtagttaatttttaaatgctttcgattgaaggatcgtcacgaaggatggtgatcaatccattcaaaattggtgcacagatcacctctctttggggcagataagtctcgagtctatggtgtagagatactaaggtgagagtgcagatggttgttagagaataacttacactgagcgtgatcaatacaaaaaattacttggatgtctactcactcatcagtgatcttctcgatactgtagtgatgtgactggtcctttgacctgtagtgtattggctattcacagtgaggctacttagtttgactgcacattctcttagtctctagccattcaggttcttattatatatgttggctattgtaggttcagattcgttatttgaagtaggatgcacctagatgaaatctatcaatcttggtagaaaagaaaaaattctatacgatttataagattgagttcagaaaatctctggccagactaagtgtgaatactgaaaaagagttttcataagatttacaaatgaactcaagtcaaatcaatctagcatatgactgatgatagaatttgacgagttctccatgacctccgtcaagtcgaaactcataatagagaaattgtatcatatgataactacacctaagggttcatttttttattctactagattatcatcacatgttactaggcataactggtagattgtgagaactcactaagattatttttggatcaatgatctttgttgaggtgagttagaatcatttcaacccatctaaaagagttccgatgatactgtgatagagatcacggtatatctcactaccagacagaatagaatctgaggggtcacacacaaaaagagtatgacctgatcaatggcttagattatattcgaattatcaatcagattaatagtttaaattttaaaaattgctaatttgtaattgttataattttggtagctgctaattgttagcacagtgacttaattataaatattataatttttttgagactgcttaaattataaattaaattttaattaatttaaattaaattaaattaaattatatttaatttaatttaatttaatattaattggattcaattatccaaattagatttggatttcaagctcgattgaatcaggcttgacagctttttgaattcgacttgattcggactcaatttgaatccgattaagacccaacttgaacaagaagaatcatgactcaaagagcccagattctctgagactcttactttagaaatcatgccaagaagggaagaggggtgatgtttttctcatgcttctcttcttgcgtgcgcaaaggggagggggcgccaatagttagcgccccaccatatttgggtttctttttctttcaatttttttttatttgaatatgattcaaagtaggataaaaatatatctaattgaagtgtggaaattttttttgtgtcataaaaaaattgaagaaagagggcgtgcactaattatgagtggaggtttctttcttacatcacaattttatctcaacacttttctaccctttgatttggttttcaatgccctagattaaaagagattagatctcttagaaattaagaagggtttggggcatgagggatttgtggtgtgcgataaaaataaaaagagaggtgtgaggtcttgcgtgaacaagaagtgcgacttttttaggacatcacaatccttcctacgcctcctcctcccttctccccttcatctccatgccaagatctgatggtgatcagatctaagaagaggaaaacagagagaaaaagagaagaataagaaattttcttctcttcatggtgatctggttcagatcccatcgaatctgcgtgaaagagttcgcacagtgatcttcttcttcaagatctagaagaagagatctagatccaaagttgaggagcgagatctataaagtgctagcacatcgatgatctcgatgctccgatcagatatcttcgtgtggataccagcagagactagacgtgtgtgcagctacgattagaattcggatatccgcatatccaaggtatagagatccgatcttcgattgtttttgctaaccatttgtttttctttttagatttcagatcgtggttacatgttcgtatcaagatctttgctacaatttttagatcaaatctgatatataaataaattaaaaatattttaatttatttatttttactacttagatgtttaaaaaaaatttaaactatacgtacaaaattatagcgattttctaacagtagtatcagagcaagattctgatatgaacataaaaatctctcaaatctaaaatctaatttgtaaaaattagatctgaaggttagtttgatgatctactcattctgaaataagggtgttctgacataatcctgttatgctaaatgattatcctaaaatgatgtagaacatcgattaaggtcagatttgaattttctacatattgtaatatgattatcgaattattttagatataaaattatttcagatctgaaataaatcatgagtttttcagatctaaaattagttttagatttgaatatatcaattagagtttaatttagatctagtatgattgctgaaatttttcttatatgcatagaattaaaattattattcatatatttgacatgtgaaagataattagatctaatttttaattaattatatatgtgatatattagattaaatttttagtagcttagtaatcgaattgggatagtcactatagccgtccgatcataagatgatgaagggattaaagttcctttcttgcccattcgatgggttctctcttatgacgtgtaggggtatcgactgtgatatttttcatgaagatgaacagcaaataaaaaactatatatgatataaattttagatttaaatcagattatatatatatatttatatattttagatcattaaaatattatatttgatatattattttgacatacgatctaaaacttaatttctgtaaaattttagatccaaaatcctaggttctgtttgcatgaacatatgaaactgtgactagtatgcttgtagagttgactcaattcttaattgggtcgactcgagtgcttggtgagttaactcatttttgttggagtcaactcaagaccctggtaggtcagctcacttactgatgagccaactcaattgtgcaggttaggtcacaggtttctatttatctcagtgtatgccgactcactatgataagtcaattcatgtaccagagtgagtcgactcgattctacaaataacgatattatatgagataacaatataaattatttagatcagaaattatttcgagatctaaacttaaacccatgtacataatgcagttaattgagaattaatatttgaaattataaaatctaaaattatgaatttaagatctaaattttaatacataaaatatgagtttcaggtatgggttgaacaaattaagtttagagactaaattacaactaggatcattgattagatcaggttagaatcctttcgattttgagcaattgatcgaacctaatcaatagttgattgggattaggtcaaaagggctcaaaatagaatttagttgtagttggtcaaattgattcacatttgatgtgaattgattaagtcaagacctaatttgacttagcgattcaagtctggatctataagttaacctaattaattctaatcaaccaatttggtatctaagacaagtactagatagtgattatttaattgattctattgtctgacctgatcaattcattggtgtttaagaaaagcaacggagaaaccttactcatctttatttgtctgatcattttgaaagattatattttgtattaggttacttgtagatccgagttcacccatgccaactaggttggtcagatatgaaatatactgacccaaactatattagtcattatatcagatgtatgtgactaattagaagagacctaaactcaaatcttctcactaaatatttagttattggtcttccaccattgtagagatgtgggtgtctttttcgacgttgatcgttctcgactagttacagtggttcgattgtatcgacaaggtacaatcactttattggcattagatgacttgggctaaagatggtgttgggcccaataactgttaggtgagggacccaatgacggctttacacttgctggtgaatgatgggttggacttaactaagaaatatgccaataactgttaggtgagaccacaggacttagagatccagtcgctgcaacatgcttggagaagcatctggataaagagttgtccacatattgatatacgtgttatcaataactgttaggtgaggtgccgtatatcgataggaccacaacatccactagaactacttatcgtgttaggattttcttctccatccgagtgtgagagactcgaaaaattagtgagagcctttgtttgtttttaaagtccttagatcaaattattacaagtacaatcatctaattaaatctttactctctatgatcaattttttagcttccaacactcaagctcgaatcctagatattaaccatttagtcaaaattaaattacatattctggcttaaaaatctaagaatagttcttagcttttagaaattaaatcatgattcttgatcaggttaaaccaatgtcatcagtttgtccaatccatgatcaacaagctatacttgacaaatagttggacattgacaattagattaggtgctataaattaaacttcatagttgatgaaatctaatgtatgcataaggacatgtagactatcaatgatatattaattcatctgcaatagttgtaagatgatcagagtcgcacagtgcatgagatgcatgatggatattttatccatgatcgatgatcaaggatattgaagagcttgagaagctcgacatgaccatgcataagatattactaatgaatttgatcctgtgatctttaattcatatggatagtttgtgaaactattatatgaataaatattataacatcttaattgaattggtcgatatgctggtaactaagggatcttgaaaagttcgaaggtacatacctggagaacctaaagaaatattgacacgcttttggaaagtatgtcaaattactcaaaattgatattacaatttttttctttttcattagactctagtacatattacgtattctaatataagatctaaggaagaaagaggactgaaggaaggtggagtgacttttttgagtcggtaatgatgcaaatattgcactgagaccgtgagtacctaatctcagtgattatcatttggatttaattctttatcatttgcatgataatgcatttgtgaaaattatgtgagcaaatagtgaatgccattggatctgaaagatccaaaaccaaataatctaaagtatatagatggttcctttggctaagtcatgtatgagaagaaatgatttgccgaccgaagaaaatgggctttttgggctcattgactgttaagtcatatctagtctacaaatcatctctttgaggattaatgactaaactgtcctttatgggttaaagagataagaccactgagatacttatcttagtacacatacaatatgcatggcctatttgatgaactagactaggaggttatcactactttatcatctttaccgatgaacagtcatggtataagtatgtatgtaaaatacaaatctgaaagattttgaaaggttcaaagaatttaggtgtaaagtaaaaaagataaatggaaaagtttctaaagatactttgatcagatcgaggatgcaataccaaatggagaatttatcggttatctaaaagaatggcatagtttcatgatggaattctctttgtacaccccagcttaacggtgtatctgtgaggagcaatggtgctatatgagatatggtatggtccattatgaatatcactaatttaattattatttttttaagaatataatttaatttttgaaatttaaattatatttcctctgaagttggtttcaccatactatatgagatatgatatggtggacaggttagaaaataggtctgtgagaactcatttatggagtatctcaaaaagatttgagatgtcactttctcttcccagtggtccacaatgtgattgtgaacaatcatactgttttcttgaaaacaatgagaggatgaactcaaagagaaaatctctgaagaacaatgagtcacaggacctgtacaacctatttaagataagccagtatatgtagtactccttcacctctaaatctagtaggatctcccatcctttagaaagatacttgatattcttataaaggattcagagaaagtgtttctcgaggaagattgagaatataggaatgatcccaaaagtcctacaacgatgtgatatgaagaatcatgtagttacatgaaggtcaataggagagtcccatactgacatcggttaagatatggttatatatagaattttttttttcaaaaatctaggtcaaacattctaaaaataaaaagtctatagagatagatcttgaaaggatgtttattttttatagacaaatatatagaagaggtgttaaaaaggttcagcattaaaaccttcaagagggatccattatcctcttaggcatgggtgtatacaatgctatgtactcgacttggtatatcttattgtgaaagttatgagaaaatattagtcgaatccagactgggagcattggatggctgtgaaaaatatttttgagtacttaagaagcactaagggattattcctcatctttgaagaagggttagagttaagagtgggaggatacattgatgctgatggtagaatatttacatcagtatgtattcttgagtcatgttggtttggtatattggaagggttttaggcaatcaactaatgaaagctgaatatgctatagatgtgtagaatgcattctggttcttatgatagttacagaactggatgtcataccattggatgctttgacattatactacaaagataatgatccatagccatcgctaaggagccaaggtctcatcagaagtccatgcacatagcacagagatatacgtgattatctcaagtagaaatatatggaggtacagagagtagactccatataatagtggtagatccgagtcacttagccagctaaacatcgaagcctgtcttcagaagatggggctcaagtatatgacagattggctttagtgcaagtggaacctttttagatgtgtgttctagaagccaatcttggctaacacatacctttctctaaggcatgttttgtacttgatgggtagtctttataactaatcatgttatttgtgtccatgatttatcttaaaaattaacaaagatgattttgtatacttttaaggtgttgagaatttgagacatacatcattagtggttaatttctaaatactttcaatcgaaggatcatcacgaaagataatgatcaatccatttaagatcagtgtatggatcatctctctttaggacagatgagtttttagtctgcagtgtagagacactggggtgagagtatagatggttgttagagaacaacttgcactgagcataaccaacatgaaaatccatttggatgtctactcactcatcagtagtcttctcgatgctgtagtggtgtgactgatcctttgacctgtggtgtattggctattcgtagtgaggctacttagtttgactgcacattctcttgatccctaaccatttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctatcaatcttggtagaaaaggagaagtcctatgcgattcataagactgagtttagaaaatctctggtcagagtaagtgtgaatactgaaaaagagtttctacgaaattcacagataaactctagtcgaaccaatctagcatatgactgacgatgggatttgacgagttctccatgacctctgtcaagttgggactcacaataaagggattgtatcacatgataactgcacctaggagtttatttttctactctgttggattaccattacatgctgttaggcattaatggtggattgtgagaacttattaagatcattttcagatcaatgatctttgttgaggtgagttggaatcgtttcagcccatcgaaaaaaattttaatgatactatgatgcagatcatggtgtgtctcactaccagacagaatagaatttgagagatcatgcataaaaggagcatgatctgatcaatagcttggatcatattcaaattattaatcggattgatagtttgaattttagaaactgctaatttgtaatcgttacagttttgacagcgattaattgttagcacagtgacttaattataaatattataatttttttgaaattgattaaattataaattaaattttaattaatttaaattaattttaatttaattagatttaatttaatttaatgttaattgggttcaattatctaaattagatttagattgatcaggcttgacagctttttgtatttgactcgattcagactcgatttgaatccgattaagatccaacttgaactagaagaatcatgactcagagagcccaggttctctaaaactctttcttcaaaaattatgccaagaagggaagaggggcgatgtttttctcatgcttctcttcttgcacgcgtgaaaggggagggggtgccaattatttggattttttttttctttcaaatttttttctatttgaatataattcaaaataaaataaaaatatatctaattgaggtatggaagattttgtttgtgcaacaaaaaatttggataaggagggcgtgcgttaattgtgagtggaggtttctttcttacatcacaactttatctcaatgcttttctaccctttgatttggttttcaacaccctaaattaaaagagattagatctcttaagcattaagaagggtttggggtgtgagggatttgtggtgtgtgacaaaaataaaaaggaaggtgtgaggtcttgtgtgaataagaagtgcgacttctttaggacatcacaatccttcctatgcctcctcctcccttctccccttcatctccatgaccaaatctgatggtgatcagatctaagtagaggaaaagagagagaagaagagaagaaaaattttttttcttttcttcatggtgatctggtttagatcctatcgaatctacacaaaatagttcacgtggtgatctccttcttcaagatctagaagaagagatctagatccaaaattgaggagtgagatctgcaaggtgctagcacaccgatgatctcagcactctgatcagatatttttgtgtggatactagcagaggttggatgcatacgcgattatgatcagaacccagatatctgtagatccaaggtatggagatctgatctccgattatttttgctaaccatttatttttctttttggatttcagatcgtagttgcatgttcagatgaagatctttgctacaatttttagatcagatctagtatgtaaataaattaaaaatattttaatttatttatttttactgcgtagatgtttagaaaaatttttaaactacacgtatgaaatcgttgcaattttttaacagaacctactgtagccaacatacaccgcaaaaatctatataactaggagatcaagtgaatatacagtcaaactatagcaatctcactataagcagtcgaagcactgcatgtcaaaaaactactcacataactacagcatcgaaaaaatcactgataagtaagtaggcatccaagtgacttcttattttgatcatgctcagtatcattattctttaataaccacctacactctcgttcagtatctccataatgtagactcaagactcatctatccttaaaaaaaatgatccatgctccaacctcatcggatcaatcactgtttctatgatgatccatcgatcgaaaatagtttagaaattaaccatcaatgacacatgtctcaaatttttaattcttgagaatatggatcatcatcctgttaattttttggatgattcaaagatacataacaagaatagtattgaaaaattatccaattttattaataaataaaatatatcaagtataaatttatgtcctaaagcaatacaatgtacctatcaaattgacttctagaacatacatctaacatctcataggtcttataatctatcagtaatatctaacagtatgtatatagctatccagtagaatagaattgaatgatcaaactttttttagatgtagttaacacatgatacaattcttctatcgtgagttctgactagatggaggttatggaattactcgtcaaatcctatcattcatcatatatttaatttattcgactcaaatttttgatatgaaaatggtgaaaatttttttcactattcatactgccatggctaaagtctcataaatcacataggaccaactctcttatctatcaagagtgataaatttcatacagactcacatcctattcctataatgaatctactatagccaacatatactacaaggacctatatgatgagagatcatgtatgtataatcaaactatagtaactttattgtaaatagccggggcacgatgggtcaaaggactagtcaccctattgcaacatcgagtaagtcactgatgagtaagtaaatatccaaatgatttcttatattagtcatgctcggtatccttatttactaataaccacctgcactcttgcttcagagtccctacactagagactcaagacttgtctatccttaaaagaaaagcaattcatgcacaaatctcatcaaatcaattaccatccttataataattcattaatcgaaagtatttaaaaatcaatcaccaataacacatgtctcgaatttttaacttttgagaatgtgtcgtcatcttattaatttcatagatgatccatggacacatacacaatatgaatgaaattaaaaatttaattttattaataataaaaaaataaatataaaattatatcttaaaataaatagatgtgtcaatctgactgatttctaaggtatacatctaataggtcctactctatggccctctattcatcttctctcctttagcgctcacacataaatcaagtttttttttaagattttggaattgtacctcctgagaaatggaagtagtctccttcggatctttagtcaattcttctttcttttgtttctctatcatccatcgcaacttctttccctggcagatcagttacattatgaattactagccaccaaatttctctgcagtgtgtctgagttttgtgcctcccctttgatttgattgttaaggtatttgctcctagtttctctattccctataatcttcctttaacactagaactttagtttgtgggggattctaaccctgttgaactattttatcttgtgtttttgttggggatctcttctttttttttgcttttgatgaagtaccagtaacctcaacttgtaaataactagcaactttagccatcatcgaatttggagcatctttctttgattgttcatcagatagaggaccatatcttgaaccaattctattctttccatttcattgaactatgttgcatttcttagtggggattttttttgatgtcttcctagaataagaccatgctccattgtattgtgcagtctcaatagttggtgcagaagttcttctactctcagacataagttgaggggcaattaagactctagctactctaatccaaggaccaaatagagattttttggaaggaatatcacctttggtccaacaatcacaagattctaaagtcctcccaagcaaaccacagtggtagctaagcttcaaaatttcttcacaaataaattcttgccatatccatcctacctcaacttcgaatttactttttggacaaattttcttggtaatatcgatcttcacacagactctagcatagcctatatgagtagacttctccatctactcatccaaaaataggggaattccaacagggcttgcagtccgcagaatgatttctttctcctagagttctaaaattaagaagatctgccaagtagatccacaccttggcttgcttgatagtatccctatcaggttcgaaccccgatcaccaaccttctaaagcaagcaacaagcctgccagtgtccatggtcccttggctaacacccggcctatgtcctcctctgaaggcagattaaaaagaaaaattccatctaatagtggagggatgtggagcaccccttccaatgcccacttggtttttttatttctttttgtcaaaactccaagggaaagtctctaccaagaaacttacctaaaaaagctgatttccatctttgactaccatgatcaagctcctcttgagataggaacaccacttttgtaaatttctcctctagagtggtgatgtctgctttcgtcacgctcaagatctctcaccaaaagtgctgtgctccctgaaccacttgcatccatgatcatcccccttttgtcttcttaatagaaggtcgatctagatggtgttggaaattatgttccaaaatcaattatcagtccattgatggttgtgctagtcaatataaatgtatatgaattggtaaattaataaaattattatttaatttttttcatcataaagtagtgtacatcttcttaatgaactctaatattatgatgaagtccttaggactattctaatcgatataagaggatatatcattaagtccttaaaataagttcatgatcaaatgatacgctgttactaggatgatagtgtttatcgagtgtaggtcattgtgtgtcatatgcgttggttgtcttcataatcaagaggtgaagacactggtatggcatacaagtgagatgtaggagtacatttcattgaatgtgaccaactactgagtattctactatcaagagtagctcatgaaggatatgggtataagtatccctctgatctaagatcatcatggtgacttacaagcaactcattatactttggtgtcagactatctgaatttttaattcagtgacagaagatttttgggtatagtcatggacttacgaagtcggtgtatgagtcaagatgaaattgacccctccgaataagaagaagtaagtgcatcagtatattttaattcaataaaactttggtcagaataatccatgtgatggatttgaaaggttgaaacacaatgtggctgactatttcaaaattgataattaaacttcaagtcaccttgagcattaggatcaaagggataaattatatggtaaccatatgtcaataggttcatgaataatgctttgcaatctttcgatctatccggacatcggataccattgtcatatgatcactttaattggtataaaaaatttattcctatactatcgacttaggttcgaatctataaggtacacttaaaagaaattttcaactaatcatgtagctgatcaatgattgaaaatcattctaggatttaatcattaattcgattaaccttgtacaaaagtaataataaattaatttgctaattattgatgaattaaaagaagattgattaataattagattgctaattaactcaatttgattaagtattaaagtttggattaaatctaattgaattggatttaatttggtttgatccgattagattatgagatgacctaatcgttaaagatgtttgatttctgattcgagcttgattaatttctaatttgattagaatttaatcaagatcatttattatctaattagatcagataatctaattagatctaacataatttggttgcgttaagaacctaattagataagaacatacattcgaattcaaatgggataagaataccccttgcgccacctttcactaagcccatcctttcttcatgcgtgaaagctattttcacatggaatttttggtgcccagaaggtgtgtgatgccttcttctgatcctcttaggattgaaattttgttggattgagtttgaattcaaattggtttgaaattaaacttaaatcaagagtccaagttttgtgggactcttccaagccaccaaccagtcttctttctcatgcgcaaaaggattttttgcatgggttttttatgccaatctgagctttgtcacacccttttctgagtctcttagatgtggattaagtttggttcaaaaaaaaatttaaatctaatttgaattcgtgataagatcaaagtctatttgaatctgaaccaaatcatccaaactcttcatgggatgccactttaagaaggactaattttttgtgtgccaattaaaattagatttggcatgagagaacctcaaagatttggcatgaaaagccaaagagaagggtgggcatccatgcatgagaaaaaggggaagaagatcctctttggggcgtaagatccagggtgggacttctaggattttctagttccagttttgtgagagagaaaaataaaagaagttttgttcttcttcttccacaccatctcctccttgaaaatatccatcttctaatctggagatatccatttgatctaaagaaaggagtctctatcagccatccagagccttcatcacaagctagcactcccagaaaggatgatctgttcgagacttcaagtggaccccctgtagaggctggacatgctgtgcgattattcagtatcagaaaggacctcctaccacatgcatcagcaatggtgatcgtcgacccatgatcaggtaatgggttctgaactcatcggatcagatctaactgttagatcttattcagggcatcgatacgatcgatgcagtcttttctttctgatcaaattttttttatatattattttcatgtcataaatttttagataggtagtttagatctaatataaaatatatatagaagattaaatagtttaatctactactttcgctataaaaattttaaaaaatacatactttgaactgtctgtttttcaacaatggtatcagagctttgatttcttatgacatgaattttttacatataatctgatattaatctaattttaattatttagattatatctaaataattaatttaatatcataataatctgattggatagatctccatagctgtccgattataaaagaaagtaaagttttacgatcctttcttttcattcgatgagattctcatatggcttgtagggatgctgcgtagtctttttcatgaaaatgaataataaaaaaaattttaaaactttattttagatctaaaataatgtatcttaaatttgaaattagagttttgattattggatgattgtttgtaaaaatattttacaaaattgaaaactattttcaaacaccaaaccccaacccatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggttagctcgattcaaatctatttaactggattagacctaggattagaaatcattgataatagactatgttagtaattgatcaaatctaattaaaagttaattctgattggatcaattttttttttgattaattctcaatagttgtagttggtcaagtctatgtctttgattagattaagatggactttgatcatagctctgtagtcaaacccaagtctataagttgatcaagttgaaacagactaattagttgatgtctaaggtaagtttagcaatattgattggtggtcattaattgggagctactcgtataaattgagtctatggtgagttaacggcatatccctcccaccgatctcacttatctgaccaacatggtcaattatattttgaatagatcacttaatgattgaggttgacccatgctatctaaaaaatcagtataattgatttaggtgcccctaattcaacttgtcttgagtcctcttcataacttgatgaagttagtgggagaatttatgacttattcaatggaccagattaaatctaatcttctttaatctgacttagtgaagtcagtaggaggattaaaaataactgattgagtcttttctcatctatcaattcaattaattaaaatttttaaaattattaggtctctaaatataaaatagttatggagataactagatcataacctcctattaagttggatgataatgggttcactagttggatgatcattggacggcccaaaggcctagtgctcatctgctattagaatgatcattcataatatgatgactcagtcgagtttctcttatgggtgatcaggatgaccgaccaaagctggatcaaatcacttatggttagattcctgagtatgatcatattaatagttggacctaaccaatcagtggaggccaaagcctattgttaggatcctgaggtaaaattaactactaaaaattatttgataaagtaattggttaagaatctattcatagaatgcacatgggtgagccgaccaaagtcgagctcatgtgcaactatgtggattctagtatctgctaaggaattagaataatttcttgaattggagatagagactaccaattcatttaaaataatgggacaatctttagactaaaatctatatctttaggcttaatcaattcatgcactaattagattttgatttttcttttatagttatggccaccaacttgtcgttccgatcattgttagataatgataaattaaggagacctaattttgatagctagtatcgaaaattgaagatagtcctagagtacgagtggatcttgtatgtactgatagatctggcatccgaggagtctgcttccaacactcgtggtgcggtttgagatacttacttgaagtggctcaacgaccgtaccacagtcgtgtattatgcgagcggctatgaatgatgagttcagttgtaaatttgagaaagctcagctagaagaaatgctcaaagtattgaacgattcttttgacactcctgatgatgttgagcggcacaacactagttgtgctattttcaatgccaggatgagggagggggcgtcagtgatcgatcatatattgtacatgatcgaacagatcgagcaccttaacaagcttaactttctcttgcatgagcagcttggaaaagatgtgattctaaattttttgtcgaagtcttacttactatttctcaatcattatcgaatgacgaagccggtagtaaactaccacaatctattgaggttgctgcaaatttttgagaaagatcaccagctccacaaagagacggtgaatgtaatgggagcatcttcttcaaacgagcatcatccctttaagaaaaggaagaaaaaaaaaataaagtgccaagtgctaggggtcagactgtgaagttcaagtccaagtctgatcaaagtcaggcagagtgcttctactataagaagcaaggttattggaagaggaactatccttaatacattatttttcttgatccaaacaggcctaagaagaaaaagcaatcgattgctaagcaaggtaattaaatgataactccttgtaactttttaatttatgatacaatgatctgagtattagatattgatagtcctattaatatttgtaattcgttgtagaaacttcaggtcagtaggagatttgaagacggtgagagagattcctaaacattgaagatggaagatcaattttagttttagctttaggaatcgtcaaacttatattcaattctcatatcattattcttagtaattatcattattgtcctagtttcttattgaatgtaatttttgtaggccttctggccaaaaaaaattatgaaatttcaataaaaaaaattttatgatattattttgaatggtgttattgtaatgcacagataattgaacaatggaatatattttgtattgcgacctagtgtaatgtacacatcgagaaaatatcctaggatagataatgtcttgaagagctatctttggcattgtaagctaagtcatatcaacaagaacaggatgaacaggttaatccgagagaaaattcttaacaacaatgattgtgaatcattgccaacctgtgaatcttgtctacttaaaaagatgaccaaaccatcttttactgaaaaaagtgaacgagctagtgaggttctaggtcttgtatatactgatgtatatggaccgatgagcacaagtatgagaggaagacaataatacttcattacgtttatagataacctaacaaggtattggtatgtctacttgatgaaaaataagtctgaatcatttgaaatattcaaacgattctgtaatgaggtagagaaataaactagaaagaatattaaaactcttcgatctgatcgaggaggtgaatacctttttgatgaatttctgacacatctaaaagagaatgagattctcttacaatggactcctcctagaatgccacaatataatggtatctcagaaaggagaaatcgaacattgttggatatggtttgatccattatgggatttttgaatttgccaatctcatttttgggatatgcgctcgagtcggcttgctacatatttaataggattctaagtaagtctatgaataaaacaccatataagatatggactggacataaaccactactctcacatcttaagatttgaggatgtccgacttatatcagatatttaaaaacagacaaattaggatctaagtctgacaaatgtatcttcatagggtatcctaaaaaaactaagggatattacttctaccttattgataaataaaatatattcgtgagtgataaagcatactttttagaaaaaaaaaattcttagtgaaggaattagtgcttctcaaattgaacttgatgaagttcgatggatagaagaaccgacacaatctagtgaacccacagaatccaatttgattgaatcaaatctagaacctattaatgatgcaccattaaagagatctgatagagtatcatgcccactagacagatactatagtttcttgatctgggatgaggatcctgaactcaatgagaacaacaaagatccaatctcctatatggatgcaatacagagatctgactctgataagtggctagaagtcatgaaatccgaaatagagtccataaaggccaataatgtatggacattagttgactcacctgaagcagtaaaattcataggatgaaagtggatctttaagaggaagaagggcacagacggcaaggtagagacctatagaatccgtctggttatcaagaggtatcattaatgttatggtattgactatgacgagacgttctctcctttagtaatgctaaaattcattcggatcatgcttgcgatagctgcatatctagactatgaaatctgataaatgaatgtaaaaatagtttttcttgatagtgaactagaagaagaggtgtatataatacaacctgaaggtttcacatccacaaatgagtctaaggtatgcaagctttagagatccatttatggattgaagcaaacaagtaggagttggaacatgtgttttgataaagtgatcagaacgtataactttgttaagaatgaaaaagaatcctaaatgggttaacaattctatggtagtattttttattttgtatgtggatgacattctcttaattaaaaatgatgttcctgcataacaaggaataaaagtttaactgtcatctcagttctccataaaggactagaaagaagcattctatatccttgaaatgaagatctatagagatagatctaaaatggtgcttagattgtctcaatccacatacttcgacatcatgctgaaatggtttagtataaaaaatttcaagaagggctatctcccgataggtcatagaattctctctcaaagagggattgtccaacaactcaagagagagagcatatgagtaggattccatatacttcgataatggattctataatttatgctatgatatgtacaagatcagatgtggtatactcactaggagtaatgaacagataccagtctaatccagaggagaaccactgaacggttgtaaaaatcatctttaagtatttaagaaaaactaaggatcagtggcttgtttatagagaaatcgacttaaaatatgtagagtttatagacttcaattttcaatcgaagcatgatgacagtaagagcatgttggattacatctatatcctgaatggtgaaacaatctactaaaaaaattataagcagcacacagtagccgactctacttacaagacagaatatatcacggcatccgatgctacgaaagaagctgtatggttacagaagttcatcgacaagcttgaagtggcaccctccctcgatagccctattttgttgtactgtgacaatactggcaccattgctcaagcgaaggaatcgaagtcacatcagcataccaagtatattctatgcttctactacttgatccggaagatcatgaatcgaagtgacgtcgagcttcagaagatcgacggaaaggagaatctgattgatccatttactaaagccctcagtatcaaggagttcgaagatcaaaaactgaagatgagtatacaatattgtactgattggctttaggccaagtgggagttattgaaaattgtatcccaaagtcaatcgtcagtccgttgatggttatgctagtcaacataaatatatataaattaataaattaataaaattattatttagcttttgcatcataaagttgtgtacatcttcttaatgaactccaatgttatgatgaagtccttaggactatcctaatcgatacaggaggatatatcgtttagtccttaaaataagtttacgatcaaatgatatgctcttactaggatgatagtgtttatcgagtgtagatcattatgtgtcatatatattggtcattctcataatcaagagatgtggagacactggtatggcatacaagcgagatgtaggagtatatctcattgaacgtgaccaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaattgcatatatacccttataaattttttttttgcataaatacccatacgggtatttcagtcatttaaattttaaaccattaatttttcaacggcattagatgacgttggtatatatacaaaaaataaagaaaaaaaagggtatacatgcaaatcaaatattttataaggatatacatgcaaatatcaattttgaaagggtatccatgcaaatttggatgtttagaagggtatatatgcaaaaatctcaaattaatttattaattattgatgaattaaagaaaaattgattagtgattagattattaactaactcaatttgattgagtattgaagtttggattaaatctaattgaattggattcaatttggtttgatccgattaggttataagatgacctaatcgctaaagatgtttgattctagattcagactcgattaatttttaatttgattagaatttaatcgagattatttattatttaattagattaaataatctaattgggtctaacctaatttgattgggttaagaacttaattagataagaacataaattcgaatttaaataggatgagaacacctcttgtgcttcctttcactatgcccatcctttcttcatgcattaaagttgtttacacatggaattttttgcacctagaaggtgtgtgatgccttcttctgattctctttggattgaaattttgttggattgagtttgagttcaaattggtttgaaatcaaacttaaatcaagagttcaagttttatatgactctttcaagccgctgaccaaccttctttctcacatgcaaaaagattttttgtgtaggttttttgcatcaatctaagctttgtcgcattcttttctgagtctcttagatgtggattaagtttggttgaaaaaaaaaattaaatctgatttgaattcatcataagatcaaagcctgtttgaatctgaaccaaatcatccaaactcttcatgggatgccactttaagaaggacagattttttgttcgccaattaagatcagatttggtgtgagagaacctcagagatttagcatgaaaaaccagagagaagggtgggcgtgcatgcatgagaaaaagaggaagaaaatcttctttggggcgtgagatccagggtggcacttctagggtttcctagttctaattttgtgagagagaaaaacaaaaagagttttattcttcttctttcacaccatctttttcttgaaaagcttcatcttctaatctacaagtgtctatttgatcttaagaaaggagtctccatcagccatctagaaccttcaccgcgagctagtactctcgagaaggatgatctgttcggggcttcgagtggaccacctgtagaggccggacatgctgtgcgactgctcgatattaagaaggacctcctaccacatgcatcaacagtggtgattgtcgatccataatcaggtaataggttctgaactcatcagatcagatctaaccgttaaatctgattcagggcatcgatacgattgatgtagtcttttctttctgatcaaatttttttatgtattatttttttatcataaatccttaggtaggtagtttagatttgatctaaagtatatgtaggagattaaattatttaatctactacttttactgtaaaaatttttaaaaaatatatgctttgaactgcctgttttccaataaatggcccctttaagacaagccatctggtttcttttccttcggatctagcattattagtctctcctttagaagctgcagtaccaaatctggttgattgagctccatgtcagttagatttggccccttcctctccaacgagggttcaagtgaaaccctagtcatctctgttcctattcctctctttccactatttttttcttgacgtgcgtacttgttgggagactaggttaggaggttgacatatcaaatatttgttggactagtctatgttgatgtggtagactaattggagggtcgcaagatctgagcatgaaggagatatggaactctagcttatgagacgaaaaaagggatagctggcttgacattaatcctcctatgttttcacctatatacatatattaaaaaaaatctagtgaaatagaatacacccctcttccattttcctccctgaatgcttgcatccttaagcgtatatatatacgtactactttgcaataacaaccatcgaggagaaacaaattaggcctcaagattgagaggagcagctgggatagacaacaatatatatacggtggaggatgccttggagagagagacaaatggaaacagtaactcaaaaactttaattacaaaagtcactcgggtgccttgcaccaattgcactagttttacatcaacaccgctttattcagtttcacattcacaatgtcaattaaaagggtacaatgccaatacaccgcattggttggatcagttttttaatttacttatgtactttctattagatgcacaccttagaagtcaatctgactgatacatttattatttttaaaatataattttatacttaactttattatttattaataagattgggtagtttatttttattcatattatgtatgtatccatgaatcatccaaaaaattaataagatgatgacacatatgaagaaaaagaaacctgcttctttgagagaatgaggcagatagccagagtgcatctaaaaattttttacaataacttgataaagattgaatctttatctgattcgcagtagaatagggatcaaatctcctaagattttgaatccaaaatctcacgtaggtctgaatccacaaatcctctactttgcgtgcacaccaaacttcacagaaaagtgggatgaagtcttggattgaagcacctttacaagaaaataagggagtagagagaacctctgatgtaacacctcacaccagcaagaggggatgcccaaggagacttcatgccttagagaagatggatgcccaaatgggaacacgccaagacaagggtgacgctaagtcttccttcatgactcctgtctctctctctttctcaccttagcatacaatctaattattatgctatgatagttagaggtcctccctatttatagatgattttctatgacttataagactaggatttctaattcaaacagactttaaattaatccataacttatcaaagaaagagttctaaaggaaaaaggaatggcgcctaactagatgccctcatgcacccatgcctacacccaatatggggcggcaacaaccagcaccccacctgatcttggccagccatgaggagagagagtttcagtaaaagtggactctaaggatctaatccaaatatgaatcaattcgaattcaattcgaatctgattcgaaataatttcgaaaaggctgtcaatcctaaactgtttaggatttagaactaagtctaacttgaatttttcaatctaattaagtctaattaaatcagatctaatctaaaattaattagtacttaaattcaatctcttatagactccttggattatagttcaaatcttgttcatcttcagaattgaatctaaatctcatgtctagtgctagctagtcatagtcaactatttaatcccatatgacccattacttaattctcaatcaaattagtctatatgtttcatcaagtcacatacttccaaattaaatatatagtcataggtcaattctttcctacatcgtctaattttgtatgtgactccataggttcgaatactaagctagtagcacagaaataattttttgtactaatcaaaattatcatctagcaatggttttcaatgtccgaatagattgaataattgtaaggcaatattcaaaaacctatgcatatggttactgcataattcatccctttgaccctgaatgctctaggatgatctagggttaactgtcaatcctgacagagtcatccatgtatttcaatctttcaaatccattacatagattatcctgattaagattttaataaattgatatatagtgatacatcagctcctataatccgaagaaattaatctcatcttgatccaacacagactttacaagtacttgactgtacctagtagccttccgtcactgcattaaaaatacagatagtccaacaccaaaacatagtgagttgcttgcaagtcactatggtgatctcagatctgagaaatacttatgtccatatgcttcatgagctgctcttaacagcagaacgctcagtggatgagtcacttatttagtgatgatgtactcttacatctcacctgtatgccataccagtatctcgatactccttgatgaagaagacaaccaacctatatggcacataacaaccttcactcgataaacgtcatcatcctttaatgacgtatcattagatcgtgaatatatttaagaactatacgataaatctttctttatcgattacttcatagttctaagaactttatcacaatacaagagttctataaaaaagatataactttgtgataaataatgtcagaataatttttatttatcgatcaataatttatatataaaaaaatacaatcatccatacaattgattttaggatacattttccaacaactctcacttggactaaagccaatcgggatagtatcttatacccatcttccatttgtgatcatcgaactctttgatcttgagaaatttagtgaagggattggctaggttctcttttccatcgatcttctaaagtttgacgtcacctcgattcacgatctctcgtacaaggtgatagcgatgtagaatgtacttggtacattggtttaactttggttctttcgcttgagctatgactccaataatgtcgcagtatagcaaaatgaggccatcaatagagggtgtaactccaagctcggtgatgaatttttgcaaccacaccgcttcctttgtagcatcggatgcagcaatatattctactttgcatgtagaatcagtcattgtacattgcttgaaactcttccagcatattgctcctccttttaagataaatacatagcccgacatgcttctattgtcatcactatctgactgaaaattaaaatcagtgtatgttgaactgtttcaacatagtattgatgtacgtgaattgagacaatccaagtaatcttctaaatttatccctatagatctttatccttaggatataggatgcttctctcaaattcttaatggagaactgtgatgataaccatagcttcacactctgtaaagctaagatgtcattttctatttacaatatgttattcacataaagtacaaaaaagatgactacaaaattgttagcccacttgtagacgtaaggttcttctccgttcctaataaagccatacattttgatcactttatcaaaactcatgtttcaattcctagatacctacttcaatctatagatggacctatttagtttgtacaccttagattcatctatgaatgtgaacctttcaagttgtatcatatacacctcttcttctagctccctgtttagaaaaataattttgacatctatttgtcaaatctcataatctaagtgtacagctattgcaagcataatctggatggacttgagcattaccacaggagagaatgtctcgtcatagtcaatactataatgctgatagtaacccttgacaattagacgggctttacaggtctccacctttccgttcgctcctctttttttttaaaaaatctacttgcatcctatgaattttattccttcgaacggatcaactagtgtccatacactattgatcttcttggactccatctcggacttcatggcctctagccatttctgagagtcggacctttgcatgacttccatataggtgatggatccttattgttctcatctagtttgataggatcaccatctcagatcaagaaatcatagtatctatctgattgatgtggtactctattggatcttctcaatggtacctttactggcttaggatttgatttgtcaatcaaatctgattctgtgtgtgtcaatttttctatctcataaattttatcaagttcaattttatagatattagttccttctttaaaatttttttttttcaaaaagactgtcctgttgctgactaacacattttgttcttcagcaaaataaaaatagtatcctttaattttctttgggtaccctatgaataagtatttatcgaactttagttcaagcttatttgtctttaaacgcttgacataagctggactgaagcgaaaatttagtgcaggggaaaaatggtaattttaaaactttttcaaaattactattttacagcagaattattaattaatctcattaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattcatgtactaatacaaaaggagcacaaccgtcaacaggctgacgattggctttgggacactattcccaacatggacacccccagaccttaaggtgtgagaacaccgacctacgtcttgtccatatttcatatggagttttatcgatagacttgctcgacactttactaagtattgggtttcgacatgcacaatggaagcactgatgtttaaaattttttattcaaaatacctcagcacaccaaaaattcttaagcccagtaatcacctggacaatacaaacaaagaacaatatgtaatcagagggtatcgagacttacctgtctcactaaattttcaccggcacacaagtgtctaccctccaatggtatccacacaaaaattgtactaaggacagtgctccaacttaagtcttgcttcaagagttctagcccctagaactcgactagcctcgcatctgaaagtcaatgcctccatttaatcatcctgatcatcagcacatattttgaaccattgaaatgcttcttaggatttctaattttcttctctaagatctttattagccttgatttaataggattagcccttgtcctaaaatgactaggctgtgtcctaatacttaggctaaatagaagaactttggatagcactttgtcctgaaaagaaaatcacaccgaagtctatttgtcgtgccttatttatagagtcaaaagggtgctaatgaagcaccacatcccattccaaatgcatatctaaaatgctcttatcagatttgatatgacccttggtagaaggactctaaagaggcatatacagtgtttcaagcttctccccatgcacgcacccagagagggcattttaggcatcatttgctaattagaaaattttcaaaaattatcactagaatttcctttcaaagatgattcagaaaagctaagatttctgatcagaagatgcctccttctacttaaaatagaaggaaaagtcgcaaccctatgcacgaccaataaatcttgtgcgcatacctactgaagagatgcctttcttgcgacctttccttaatcagatttaatttaggtttgccacatagagtcaccatttaaaaataatccagataagaaactgattaagaagatgcctctctctgcttaaggaagtaggagtttcacattcctttgcgcattcagaaattttttgcgcatgcaggtcaacattcttggtgtcccacgccaaatccagaagccaataaaatcctcaaaaatagtgctgatgaagatcaaccactaatcttcatgtcacatgagcttcaaacccatcagagaaggatttccaatccttcttatgccaaaaactttatcgcacgcaccctcgaatttgggtgcctagagtcccacttgattgggtctcttgattatagtgtgtggctaggaatttgggtgccttatttggctgcctcttggaggctaactcagatctaaaccctaattaaccattaggtcaattaggtttgatcaattttgcaagattcaagcccaaatcaaaaccgattcaaggagctagggtttctacatgtgctagcatgcttactggaagccctgattggatcccaattttcaatcaactatatcaaatggatccttggccaattctttaatacgtgtgaccctttgagtttctatctagccagtagtaggttcgggtgctagttagcctaattcaattagactacttctaatcgattaaggtccaaactatgccaacccatgttgtcaaattagaatcctttctaatttactcatgaattaatcactttaattcataaaaatctacaaggcaagattgatgtccagcaatatatcatgcctacctagaagataagaaatttgataaaaatatcaaatatatccttcagtagcgagttgccgtgtaattcaatcctttgatcatcctacatcccgaatatgtctgtaagtataaaaatatatcaaactcactaacatatttttcttgattatccatcaatcagtgatgactcaatgataaaatattagaaaccttctaatattcatcctactctggccaaagattttcaaagtcatctagagatgataatacataggatgacatctcctcttactaggagtgatcgatttcttgttgacctactcacaacctccatgcatattcttctatatctaaaatatctgattcatgaattaattattatgagtgagtatgaactaaaatatagattcttgtgcataaggttctatggtgatctcaggtctaaagatcatttgcacaactctcacttagagaatcatcttttgacatgcagataagactccatgaaatgttctctcttagtgaatcaattcagtaaatttattttctaatgagcaccaacatctttatattagtatctcatataagtggcttatgagatcagccaccctctccatcgagtatacataggatatgccagtctatccggaatattaatttctgactcaatgctcctatgatccaaaatattttagattagaattttagatctcacagacatgaactctatttatgtcctctaaaatttttgacctaatctatggggttcatcataatgttaatagaatacaataagatgcggctataataatgaatcataatgtctcaattcatagaaatatgaataatatcataacatgagttggaagattatctagaaaaatcctatcgcatcactcatgcgataggcttgtagggcactattctttcaatctcccacttacactaaagtcaatcatccaaatatctcaaacccttgagatgacgatcaaacagctgctgcagtaaggccttggtcaatggatctactatattattctttgaatcaacaattctatgatcccatcataaatgagatggaagcatcttaggatgtgctcaagttttcaaaagagaccttggttcaaactctagaactaaacccaattatgagatgaactactccatccagccaacttccccaagtaacttcacttagcagcaatgtaatctagttccatgcttgagtcagctacattgtcattacaaactcttctaactcactgttatacttttcaggataaactcatatcttgatagagacttgctatcatctgaatctaattgaaaactagaatcaaaatatccttctagtttcaactctgatcctccataaaatattagaaaagcatctttagtacttctcaagaacttaagaatatttttcattattttttcaaacgatcatcttctggatcagtctgaaaatttactagctatgcctaaagcataaaatcccatcaagcttagtacatagcatctcacacaaaatcaatcccacattcgaagcataagggatgatatcattctctctcactcttcaggtatcttaagtgacatctgcttagagagagatgtatgctttgacttatagataagtaaactcttttactagccactgtgttgaaccatttcaacacaaagtctatgtaccaagactgggacaagccaaatatccttttagctttatctctacagatctatatatactcagtatataggatgctttatccaagtctttcatgaaaaatatctttagatagataatttttgatcattaaaatattgagatactatttccaatcaacaaatagaactaaaaagataatagtactttcatttgtcttcttatatacacatgatttatccaccttttgatgaagccaaactcatttgactatcatattaaaaatagatgttccaactcttcaggtcttgcttcaatccataaatggatcacttagcttgcatacttgatttgtcctcctactggagataattttttttgaataaatcaaataaaccttattcttcaaaaataaatttttaaaaaattggcttttgacattcaactgccagatctagaatcaaagtatgcaactttagcaagcataatctgaatgaacttgagcattgtcattagtgaaaattttcattaaagtcaacttcatgcctttgtttttgaagattcatcttgaagattcatttgcagtctattgggatcacaccctcatgagcatcaaccaaagatcatacttgattgctttacatggagttcatttcaaatttcatggcttctagccatctgtcagagttttttctcatgataacttccatatatgtcagtggatcataatcttgaataatctgggtctcgttgtcattcctaataacaaacccatcatagaggtgcttagtgcactctatttgacttacggagaggatgtgtgtattatggatgtacctcattcttagatacttctggttgaagatcactttgtgaaccaatcacaggtgactatgggatagtttgtggccttaaacttctacaagttcaaattattctcctactgtctctttttaggataaaatatttttttcaagaaagtgacatacttactaacaaatatctattattgagtaggatggcaaaagcagtattcaatactcttctttgaataactttcaaacttttacttttcgaatctaacacttaacttatatccaaaatcacttttgacataaataggacaacctcaaatttttaaggtatttgagatttgtccatttttccttctatatcaaatatggagttctagcaataatcttgaagacatcctgtttataatatatatggcaatttctagagcaaatcatcagaataatattgaaagatcaatgaagtacatcatagaccgtaccatatctaatagagtgtaattcctccaatctaatacatcaattaactatggtatattaggaggtatctaatcagagagaaaaatagatgatcaagaaattcaacgaataagtattcatctcttcgaacaaatcgaagaaattttgatactattttcaatttatttctcaaccatacaatgatactccacttatcaaaaagctttggatttatgtttcatcaaaaacataaatccaaccttgataaatcatctataaagatgatgaattaggaatattcttctctagcttgagttgtcataggtccacatacatataaatatacaagagttaacaactcaattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccttaactcactaaaaagatcgaaatgatagtgctagagaaatgtgataaacatatcttctctctaacatttcatactttcatcaacataacatgtcacaatgaaaacagataatatcttaaaaggacattcattgcttctttctcttgaagatgcttgtcttaaagttcaacttctttgaacccttcctaccactcttcttgtccataaaaagaagttgagccttatcactcttgatagagctctctgctacttttaacatgttaagtagcattggcaagaaacttgtctaatttgttcatataagagattatcacaaactttggacgaagagtttgggagactgaaagatgagatcctgacttagttctccatctatctcaaaatctaattgactcaatctagtgatcaagtcaataatcaagaactgggcctgaatggataagcccttagacaacctggctcagaacaactacttagatatttcatatctagcagtttgagctctgctctccattcaactccttaagattaaggaatatagaatctagattcatctattcatgtagtctgtgcaactcattgcacatcaaggccaatatgatagacttgagagtcgaacagtcaatctaccatatcctctatgtggctctcacttcttcttgaagcatctttcttgatctaagaagatcaggagaattgagaatataggagatcaactcctatgcgaataccaattacaagtttctcaaccagtccacatagttcggatcggtcaacataaatgcatcaataatataatatagtgaaagtgaagatgccataatgcataatcaaaacataagaataatagaagcaatagactactcatgtagacattcataactagatgaggttttcagtctagttatgtcttttactattttatcatgtaccatagccctctcctatggtagatgagaaaatttctaaccaattttttagtggggttgagattctaattcttcataaatgccttatgttacacaacaaacattcatgagttcaaaagtaggaaactgcctttccaattgcaattcgtgcaactctcaacaaaactcctacctctaagacccttatagtcttgtgttacacaacaaactataacgtcttagtttagtcagacccttcattttcatatggtaatattcaaataatgttgcccttatattacacaacaaagcaacaccatcaaatataccataaagccctaatggcatcaagacaatcccaaatcaacacctatagtaagccttgtgttacacaacaaacctattatagtgttaacatgattttggcttagcataaaggaatgcattggtagtgtcctaatcattaagcattttcaattcaagattaaatcaataaaattgactagataaatgggagagaggtgggaggccccccattcttaccttagacaccaaatgatttggccagataagaaacggacccaattaaagaaccatgatctctttaccttcttagaaccactttcctagacaattgatcaatcattttttgaatgaatttgcttttgatttccaacactataactaaatataatttttaggagggctttccagtctcatgcacatcctatcttacttagcaaatcatatcacatatgctataatatatcatgaaaagcataatatgataataaaaaaataagagcatgctgtcccatgagtgtatagttatatcatcattctaggataatgtttgcagcatagcggacatccaccgctatgccaggaaaatcttattttagaatgatgaacataacacatgcattatagtgcataaaaaatataataacatatgattattttcataatgaatcataatcataatcatatacttctaaatacatttctatgattgattagggtttatacgttcaatcgaactcattaccttgtccgattcaaaccaaaatgaaaaaccctagcattaaacaccaatcaagatgacatccaatcctttgaatgtattgatcaaggatgactctgatactactagtgcgttttgacaaatgcagtagaagcactggtgtttaaattttttttttcaaaatacctcagtgcaccaaaaacccttaagctcaggaatcaccctaataatacaaacaaagaacaatatgtaataagagggtatcgagacttacctatctcgctaaattttcataggcacacaagtgtttgccctccaacggtatccacacagaaactataccaaggacagcgctctaacttgagtcttactttaacagttctagcccctagaactcaactaagcttgcatctgaaagtcgatgcctcctctaagatcttcattagccttgatttaataggattagcccttgtcctaaaatgaccaggctatatcctaacacctaggctaaatagaagaactttggacagcactttatcctgaaaagaaaaccacaccaaagcctatttgccgtgccttatttatagagtcaaaagggtgctaatgaagtgccacattccattccaaatgcatatctaaaaagctcttatcaaatttgataagacccttggcagaaggactctaaagaggcatatacatcgtttcaggcttctcctcatgcgtgcacccaaagagggcattttaggcatcattcactaatcaaaaaattttaaaaattatcatgtggaatcttttttcaaagataattcagaaaagataagatctctgattagaagacacatctttctgcttaaaatagaaggagaagtcacgaccctatgtgcgaccaataaatctcgtgcatgtacctgctgaagagatgcctttcttgtgatcttttctttcaattcagatttgccatatggagtcaccatttaaaaataatccagataaggtaagaaactcattaagaagatgcctctttctacttaaggcaataggagtcttcacatctcttcgcgcatccaggaattttttgcacatgcaggtcaatattcctagcatcccacgccaaatcaagaagccaataaaatcctcaaaaatagtgctgatgaagatcaatcactgatcttcatgccacatgagtttcaaatccatcagagaaggatttccaatcattctcatatcaaaaaccttgttgcgcatgccctaaaatttgggcacctagagtcccacttgattgggtctcttgattatggcatgtgactagaaatttgggtgccttatttgacttccccctagaggctaactcagatccaccctaattaaccattaggtcaattaggtttgatcaattttgcaagattcaagccccaatcaaaatccattcaaggagctagggtttccatatgtgctagcatgcttattgaaagccttgattggatccaaatttttaatcaaccatattaaatggatccttagccaattctttaatgtgtgtgatcctttggatttctatctagccagcagtaggttcaagtgctagttaacctaattcgattagaccctttctaattatggtccaaactatgccaacccatgttatcaaattagaaccctttctaattgactcatgaattaatcactttaattcataaaaatttataagataagattgacatctagcaatatatcatacctatctagaagataaaaaatttgataaaaatattgaatatatccttcagtaacgagttaccgtacaattcaatcctttgatcatcctgcattccgaatatatctgtgagtatgaaaatatatcaaactcactaacatattcttttcgattatccatcaatcagtgatgactcaatgataaaatattagaaaccttctaatattcatctcactttagctagagattttcagagtcatctagagataataatacataggatgacatctcctcttactaggagtgatcgattcttcattgacttactcacaacctccatgcatattcctccatatccagaatatttcattcatgatttaattattatgagtgagtatgaactaaaatatagattcctgtgcataaggttctatggtgatctcaggtctaaggatcacttgcacaactcccacttagagaatcatcttttgacatgcagacaaggctccatgagatgttctctcttagtggatcaattcgttgaactcatttcctaataagcatccatatttttatattaatatctcacacaagtggcttgtgagatcagccacccttttcatcgagtatatataggatgtgtcaatctatccgaaatattgatctccaattcaatgctcctatgatcaaaaatattttagattaagattttaagattttaaatctcacaagcatgaactttattcatgtcttctaaaatcattaacctaatctatgagattcatcataatcttaataaaatataataagatgcagctataatgatgaatcataatacctcaatttatagaattatgaataatgtcataacatgagttggaagattacttagaaaagtcctgtcgcatcactcatgcgatggacttgtagggcactattctttcattaagaatatagcaggcagttttaagagcatatcttcaaaaggagattggtagataagtaaagtccatcatggatcaaaccatatccaataaggttcgatttctcttttcagacatcccattatattatggtattctaggagggatccactgtgagagaattttattctcttctagatatgtcagaaaattattgatgaggtatttacctctttgatctaaccaaagtatcttaatactctttccagtctatttttctactttactatgacattgtttgaatattttaaatgattccgattgatgcttcataagatagacatatccatacctcgatagatcatctataaatataatgaagtagtagtatcttcctctagcacctatattcatatgtctacatacatcattatgtattagacctaagacatcattggctctttcatcttttttcttaaaaggtgatttggtcatcttaccaagtagacaagattcacaggttggtaataattcataattattaattttaaagatattctctttaattaacctgtctatcttcttcttgttcacatgacccaacctacaatgccaaagataagagtcactgacattagctattttagaatatttatttgatatgttcattacaccaacagactgtgataatatgtatatgccatatcttaattatcctcgcataattatagtatcattcacaataatatcataaaaattatcttttattaaaaatttataactaaatttagtcaaaaaacctacagaaatgatattcatcaaaaagaaaagataataatgacaatcatctaacatgacactactggattcgaaaataagctgcatagtttctaaagctagaactggacaagatttctatctctaacgttcaggaaccactcgtcttctctaaattttttattgatctatagtttttgcaatgaattatatatattaatcaaacttttgagattcaatatctagatagtagtatcacaaacaaagaaattataaggagttatcatataagtaccttgtgaaacaatcgattacttgcttctcttattcttagatctgtttgggtcaaggatagctatataagtaggatattttttttttcaatgatccagcttcttgcaaaagaagcattctgtctggctcttatcgactttcgatttttggctctgcttaaacttttgatcaacggcatgattcttctgcatctttttttttcttttctcttttagaggatcgatgacctatagacaaacctcctactacatgcacaggctccttctgaagctggtggtccttcccgaatgtctgcagcaatcctagcaaaccatgatagttcactatatgcttagtcattctgtaatgactcaagaaggataggtaggattttggtagcgaattaaggatagcatccttacctaattattcatgtaatgaaaagtcaagtttgcttagacattcaatctgcttgatcttgtataatatatgatcgatgactgaagtctcctttcatatacgggtattgaatactgtgcaggaggttttatatctctccgcatcctctgaatactgtgcaggaggttttatatctctctgcatcctctggaatgtcgaaaaacttattcaacatttgaatcatatcctctgactgtgcatcctcgaacttatggttaatgcagagttgccctcataatataatgcagagttgtgcaatcattgagccaattcaagtaagtgtctctcacgacacaggatgcattggtagaagattcttcaggtgcctgatccgtaagcacgtacaaaattctttcatgctccaagatgatctttaactttcgatactagctatcaaagttggatctggtaagcttgtcgctatccaacagcgaacgaaatgatagtgtgttggccatagctgaaacgtaaatcaaaaatctattggtatatgaattactttcaatcccgaagatatgaactttagtctaaaggttcttccactattttatacgacttgatagcctccacctccaattcgagaaattacattaattctttagcggatactagaatctacacagactgcattcagatctgagtatggctcgaccaaccctagtgcatccatgggtaagtttataatcaattatttcttcaaacaacttctaacaattagattttgcctcagacctctcttcaacaggcatgtggtgcctccactgaaaattttggttagatccaaccattaacatgactataccaagcgcatccaacaaacaaatgttcagattcgagtatggctcgatcaacctgagcattgatctgaatggcacaataagatggtcatacgataaatgataatttttatatccaatagacatcaagcgtatagcgcctccaatgcctattttgaatattggattcattataatacaccttaataggatgttatgaacaagttatctccataactatatcattttaaagatccaataatttagataatttaattttattgatttgacaataaaagaaaaaattaacctgtaagtcttaaatcctctcactgactttaccaagtcatgtagaggattagacacaagctggtctaaagatacctgaatcagtcatactggtttatcttaatggcatggatcaactcgaattgactagtgacctaatcaaaacataatatatcatgttggctaggtaagtgagatcagtgggagagatatgccattaactcatcgtagacaccatataggtgaataactcctaattaataaccactggatcaaaactgtcaaacttattttagacaccaactggttaattagtttcgatttgatccatcagaagattcagactcaaccattgagccatgatcatggtccatttagtaaggtcaaaaatatggactttatcaagcttcaactattgagattaatctagaaaaattttgacctaatctaattcaatttttgattaaatttaattaatttttttattcagtttatatttctttctaaccctaggtctaacccaatagaaggacatgatttatgctaacccattgcccatcgatttatgtggtgtcttagtaatcttcaattctcaaatctagatcgtttaaacttaattctaaattaagtatatgaaacatgtgtttcaatatatagaactattctactataatttcaagtgaagcataccatatgttttatatcataaaaataaatttttatatatatgttgaacaattaaacatacataagtatgatctaaacttcatacatacatcatatgtaccatgataatctttagctcagtattaattatatctaacataacatgctattcagattttaaaataatttttatgtctgaatttatcttattgtaataaaccataaatcactttagatctaatctaaacttatttatgatcaaaataatttataaaaatctattcactcttcttctttatgaaactagatcataatgacatccttacacgtcataagagaactcattgaatggacaaaaaaaaaattaatccctcctatctcttatgatcggacagtctggtgatctcatcaatctgagtactgggctactaagatctgaaatcttatttcatatgaaattatatcaatatgtaatttgacaaaatattttatgtcatgaacatgactttgatctcatcaatcatgctcttcatctaacctaatcagatttgaagcatcatatacatcatatcaaatctgaaatatattttgtactgattataaaatattaatttcagatctgatatcatattgaaaattaattagatacacatatgaacacataaagattaatttttttgttagatctattttgatgttgtacaaaattttgttagaaatcacatttgaaaatctgtccaaacatattcaattcaggtctaaaataagtctaacttcataaccaaaataataatattaaaattttattaaaattaatttaaaataaattttaaaataggttattaatctaacaaaattcagcaaataaaaaaaattctgttataacagatttataacaaaccttaatcaacaattgattaggttcttgtaacctaatcaaaattagatcataaattttatttaaatagatctaaattagatttaatatctaatataaaattttaattatatataatatataaataaattaaaaaaattaattatgcatccatgtatcaaagtctagctcggatactaattaaagagaaagaaacctatttctttaggagaatgagatagatagccgaggtgcatctaaaatttttttaaacaacttgataaagattggattttatctgattcacagtggaatagggatcaaatccttaaaaattttgaatccaaagcctcgcgtaggtctgaatctacaaaccctctatctcgtgcgcatgccaaactttgcaagaaagtgagatgaagcctcagattgaagcaccttcacaagacaacaagagaggagagagaacttttgatatgacacctcacaccaacaagaggggatgcccaaggaggcttcacgccttggagaagagggatgcccaaagggggaacatgccaagacaagggtgacacccagtcttccttcatgcctcctctctctctctttctcaccttagcacacaatctaattgttatgctatgatagttagaggtccttcttatttataaataattttttataacttataagaataaaatttctaattcaaataggtttggaattaatctataacttatcaaaaaaaaagtcttaaaggagaaagaattggtgcctaactaggcgccctcatgcacccacgcctacacccaatgtggggcagcaacaaccaacaccccacctagtcttggtcggccatgaatagagagattttcgataaaaatggactctaaggatctaatccaaatatgggtcaatttgaatctaattcaaatctgattcgaaataatttcaaaaaggctgtcaatcttaaactgcttaggatttaggatcaagtctaacttgaattttttaattcaattaagtttaattaaattaaatctaatttaaaattaattaacacttaaatctaatctctcataaactccttggatcatagatcaaatcttgttcatctctagaattgaacttgaacctcatgtctagtgctagctagtcatagtcaactatttaattctatatgacccatcacgtaattcttaatcaagttaatctatatgttcaatcaaattacgtattttcaaattaaacatataatcataggtcaattctttcctacatcatctgactttgtgaatgagtccataagttcgaacactaagccgatagcatagaaattattttttatactaatcaaagttaccatctagtaatgattttcgatgtccaaatagatcgaataattgtaaggcaatattcaagaacctatgcatatggttaccgcataattcttctctttgaccctaaatgctctagaatgatctagggttaattgtcaaccctgacagagtcatccatattatatttcaaacctttcaaatctatcacatgaattattttagtcaagattttattgaattgaaatatagtgatacatcaactcctataatctaaaggggtcaatcccatcttgatccacatacagactttgtaagtattgactgtacccagtagccttctatactatattagaaatatagatagtccgccaccaaagcatagtaagttatttacaagtcactatggtaatctcagatctgagagacacttatgtccatacgttttgcgagctgctcttgacagcagagcgctcagcaaatgggtcacttgtttagtgatgatgtacttctacatctcatttatatgtcataccagtatctccacaccccttgattaagaggataactaacccatatggcacacaacgatcttcactcgataaacatcatcatcctttaatgatgtatcatttggtcacgaacatgtttaagaactattcgataaatcttcctttatcgattacgtcatacttctaaggactccatcacaacaaaagagtttcataagaaaaatataactttgtgatgaacaatatcagaataacttttatttatcgatcaataattcatatacaaaaagaacacaatcgtccatacgattagttttaggacataattttcaatatcaattcaaagggtacaatgccaatttaaagggtacgatgccaatacaccacattggttggatcagttttgtaatttacttaagtactttttattagatgtatgtcctagaaatcaatctgactgatatatttattatttctaagatataattttatacttgactttattatttattaataagattggataatttatttttattcatattgggtatgtgtccatgaatcattcaagaaattaataagatgatgacatatattctcaagagttgaaaatttaaggcatatgttattagtgactaaattttaaattatttttgatcgatggatcatcatgagaatgatgattgatccgataatattagtgtacagatcacttccttttggatagataagtctcaaatttttggtgtggagatactagaatgagagtgcagataattgttagaaaataaatgtactgagtatgattaatatgaaaagttacttggatgtctactcacttatcaataattttttcgatactgtagtggtgtgactagtctttaacttatagtgtcttggttattcacaatgaggttactatagtttgactatacaaacatttgatccctagccatacgagtttttgcgatacatgttggctgcagtaggttcgttgtaggagtaggatatgcatctagataggatctatcaatcttggtagataaaaagtagttctatgtgatttatgaaactgaattttgaagaccataaccatggcagtgtgaataatgaaaatttttttttcataagatttcataatatgaacttgagttgaataaatctcacgtatgatagatgatagggtttaacgaatttttcataacctcggtcttgtcataactcacgatagaagaactgtatcacataataactacatctaagaggttcattccttccattctgctgggttgccactatatgctgctaggctggtggattgtgagatcaataagaattattttaatggtcaataatttttattaggtgagttgaaaatatttcaatctattgaaaaaagtttcaatgatattagtgatggagatcacaatatatctcaataccaaacagaataaaatctatgggatcacacatataagaggttctaactgatcgagattgttgaattatgatttcaaatcgctgaaggattcgattgtcaatatgattgatgattggattgatttgtaaaagttacaagaaggatttgttaatagttagtgagttaaaaaaatacttatttgtaattattgctacattatttaatgtgatcaaataattgaggttgagtcttagtcaaattaaattaagatttaatttgattgaatttagtctgagtttgaatcagtttgaatttcataagtccaaaaaggtttagactcaaatttagtatttgacttataattgaaatccaaaccaatttggatttgaaccaaccattgaccaagtctaaggaaagatcatgcctcatgagaaatcatgccaaccatattttcattggtggtttttctttcttttgcgtggagttatagggcgaactccttccaaagagtccttgcatcccaagactcttatccctaactctatttgaatttgatttagatatggattaggatgtggcgcctcctcttatctcacgcataaaggagattggcgtgaactaattggcatggaacaaagcaaataaaaagggataggggcatgcgtgaggagttagcgcagacagaaatcagatctggatgtcctttctcttctttctcttgcatgtccaaagtgttggatgttctatcctacacgcctctcttctcccatcatcctcctcctttggtttctctaatatttttttgaaaagaaaaaaatgagaaaaagattcaacaattcaagaagcgatctctgtaagagagctagtatctcgatgagatcaggattttctgatcaaatcagcttcgtgtgaatatctgtaaagaccgaatacacatgcggtttcagagaaacctgcaagacatccacggatcagtaaatcatggtgtacatctatctacgtaaggtaaagattagatcttcctctctacttttatttttattttaatcttgactataaagaatcctagatttttgagatacaatctcatgcatgtatgcatgaattaatctgattttattccactatattttaatttttatgttgcatgctatcagattttcttcaaatggccctcaattttttaactagatctaaagctgcatcattggacctggatacagacttccaagcaaaggccacaacatcattaatagaatcaagagagagccaacttctctcaaatctgaagagaggttttgacttgagttgctcggagaagttgagtagaatcggacagtgatcgaaacaaggattgggcagcgccaattaagatgaagatggacaaatgtcaccccaatcgggagaaatcaaaaatctatcaagtcttgcgaagataggatcatctcttttgttactccaagttctgacctcgaagaggcaaatcaatcagctagagtgaacggatcaatttaaggaaacccaaagtgacaccacgaggctgagggttattgctgcactcaaaaagtcagaatgtagcattgaaatcccctccaatgacccaaggaccagtgaaagagtttcggatggttttcaattcctcccggaagcctctcttcagattatgatctgtaggtccgtagacaaccgtgaagcaccaaaaagtttttaggacattgtcaaaccatgaaatagtgatggagtaggagattacaagttgctgttggataaagaacctgaaactgtcccatccaaggagaataccgccataggtaccagtggcattgagaacaacccaagcatcaatatgaccacccgataaggatctggtcacagaaggggagacagaacccagtttggactcttgcggtccaacaacacagcaatttgaggagatgatagtgtccctaacaattcttcttttaagaggttcacccagaccaattccagcataaaatagacatcagtaaatgagggacaacaaggcacgggaggaatagaggagagaaaaaaaaatccacctagtgggatggaacagaggcaacattggcatgctccgcttccatctataggattagatgaaccactttctctgcatcttgatcggagaataatgccacgttgcttacaccatgacaggatagtctcaggggagagagagagtaaaggtttaggatccactgatacctcaactgcggaggaagaggcatttgaggattgcctgacctcaattttcttccttctagaagacataagttgggtggtgacttctttgacggctagctgggcttttgttcattagcatctcttggttgtctcctgtcgatttgaaggagccaagattgaaggggtggggacgtccgaagaaggggggagtatgttaggagctaagtctggacatggaagttctaaagagtcattagtagggcccgattggagatcttggggtctggcagacagagcctcagcaaggttgtaggatgtctcatcagaagccggagacgggcccgagcagcatcgcatggcctccacctcctcacgcctggagtccatagaagcagttggtgaacaaggaaggggcacaataggactcagcataaggtcggcagaggcgcacagtggatcatccacgtgttgcatcattggtgccaccagatttgaattcaaaatcacctcagattgccagtcaatgtaagcctcaataggttgacatcgagggagactgcgagagagaggattcaagagcttcaaaggaggtcggatggaggagatcagtaaaagggtcataggatctccccttaaggtccctggcgccagaacaagtagaaaaaaggcgacaagaattgactagggaggtgaccccaatagctccatcagtcacatcaccagccaaagtggaagcggaggaataggactgaatctagactcagttctatctgggagaatctgattgagttcaatcaagggccgagttaatgtagagcacgcacctagatcgccgatcggaggaacaagtggacgaggtgagcgggcatatgggctgggagaagccaggttttccccttctgctacctcacgatgggtttcagggatgaagagtgaggggtcactgtgattgtcatcgttgacactcaagccggtgatggagttgaagaggagagaggttaccgctgatgaggaaggagcatcttcaaacccaataattccaccttcatgggataagcgaaatcaccacaggaaacatcaataataaagggaatgaggtttgcatccctgcagaggatcagaacaacgacagattccaaatcacagtcggatagagaggacggagcgatactgtccagcaagctaaagctatagacaatcttacagagtgtctcagctcctctacagaaaatagataggccgaagagcctcaagatagcatgcttcgagagagaggcctggcaccgtcagtgatagaccaaggggagcccaccaagctaaagtgcaaggaggggataggacttttatgaataacctcagcaagcttcttcttgttcggaaaagagacaagaaattgattattaccaaggaatttgggctccccaaagtgatcactagcagcagcttgcagagccctagcaatctgagaactggagaaaggatgacctttgacatttaggacttgaatcattccaaacaaagaggcctccttaatgctattaaggattccgtaatcaggtgggatgtatacctccagatgcttatccctctgttctttctcagaagaaggaccaagaaaggtagaaaaaggagccgccaagcatgtttgagaggagtgtccaactttccaataggaaaaatagatcaggccattgcaacattccttcttgaaatgccctttttcaccacatcgaaagcaagaaccttttttgaaggggacagggacaagaggtcggctatgcttttgaggtatagagatagaagaattaggtttgggatgggaatagagcgcatctttgtaggatttatgagaagtagaaggagcacacccatttgtcagaggatccaaagaggaagggacgcttcgagaggaagcccaagcaggtggaaccattaccaaaatgccatcaaaagaaacaagaggactgaaggaagaagtatatccatgatgctggaaaccaagaggaacagtgttagcccctgtagggaaaggcttaggcacacttgattttctacgaatccagcaccgagactgttggagagcgcctcgaggagatctcttcttccggataccagctctccgcttcatctttgctccaataaatcactctctcttctcgttgaaaatgactttggaccatgtctcgccattgaaactaactttataattacttttacttctaattgggttatacatgctaattcaaatactcatctatatacttcaatgcagaatctaaaaaaaaaaaaaagactaagaaaaaatgaggtgacccatcgagttagcaatgggacaagaattgctgctatagtcatggacacctatcctctgagattaccgtctgggtttaatttgatatttagagactgttactatgtacctgctgctagcaaaaatttgatttttatttcatcattagcataggatgattatatttttaatttcaataaagactactggacgatttattttgaaaacaaatttgttgcacatgattttatgattgacagtctctgtcacttacatatgaatatgtgtgaatatatctgagtaagtagtgagtgccgtaggatctaagagatccagggatgagataaatcaaaagtatatgtagcatctcaagtttgatcatattggagaggatagaataaacaaattaaaaaagcatgggctccttgactcattaaatcctgagtcatatctagtttgtgaatcttgccttcaagaaaagatgatcaaactattctttatgggacataggaagagaaccactaagatacttgtctcggtacatactgatgtatatggtccatttgatgtgcaggtcaaagatggttatctttacttcattatctttaccgatgactattcatagtataggtatgtgtatctaatgaagaataaatctaaagtctttaaaaagttcaaagaatttaaatgtacagtagagaagcaaattaaaaaaattttcaagattcttcgatcaaattgaggaggtaaatatcttagtggcgaatttcgaaattatctcaagaaaaatggcataatctcacaatagatcccttctgatacacctcaacttaacggagtgtcggagaggaagaataggactctattaaatatggtccgatccatgatgagcttcattgatcttttcttatttttttgagaacatactttgcttactgtaatctacatactgaatagagttccctctaaatctattcctatcatgtcgtatgagatgtgatatgataagaaatcgagtcttagtcatcttaagatctggggacatccaacccatgtcaagcgacaataggtggacaagttagaggctaggtctataagagcttattttattggatatcttgaagagtctttaggatactacttttacttctcagaggattataatgtgattgcaagccgacaagctatattcttgaaaaaatagtttatccaagatgaagatagtgaaagaaaaattgagttcgaggaaaaagtctctaaagagcaatgagtcatagaatctatagaatctattcatatcgagctagtacatgtaatacctcctccatctcatagatctagtagaatctttcatcctcttgaaagatatttgaatataattatagaggatgtagagaaaatgttccttatagaagattgaaaacatagagatgatcataaaaactactaccagacgatgtcagacatcgatatcgagaagtggttaaatataatgaagtcagaaattgactccatgcattccaaccaagtctggaccttagtgaatctatcagaatgtatagtatctattggttgcaaatggatctacaaaaggaagataagtttagataaaaaggtagagattataaagcaaagcttgtggcgaaaggttatacaacacgacggtattgactatcagaagactttttcttctgtgatcatgctgagatctattcgcacattacttgctattgcaacatattatgattatgagatatgacagatggatatgaaaactacttttttaaatggatctcataaggaagatatttatatggagcagcctctagatttcactttcagtgctgaagattacaagatctgcaagctgtaaagattcatatatggattaaagcaagtatctcgaagttgaaatactcatttcaacgatgtgatcaaatcatttgattttgtcaagaatgaggaggaactatatatttataagaagatcaatgggagtgcagttatgtttctcgtattgtatgtagatgacatcctcctgattgaaaataatgttttcatactgatttcagttaaaatatggctatctaaagaattctccataaaaaatcttaagaaagcatcctatattctgagaaaaaagatatataaagatagatttaaaaggatactaggtctctcatagaaaatatatatatatgaggtgctgaaaaggttcagcatagaaaactccaagaggagactattatcccttaggcatgaaatacatctctctaagaagatgtatcccaatacatttgagaagattcaatgcatgagcaagatctcttatgcttcggctattgagagcctcatgtatgccatgctatgtatacgacctgatatatcccttattgtgaatattacaattaagcagatatcagtcaaattcagatgaggagtactagacagctatgaaaaatattcttaagtacttgagaaagactaagaatttattcttgatcttcagaggaagatcagaattaaggatagaaagatacactgactcagactttatgtctgatgttgatgatagaaagtctacatcaggatgtgtgtttttgtataatggtggatcgataaattagaagagtttcaagcaattgatcattgtggactctactatagaagctgaatatatcgctgcctcaaaagctataaaagaagccttctggataaaaaattttattacagaacttgatgtcatatcatcagatgccatcacactatatagcgacaacaacggtgctatagctcttgctaaggagcccaggtctcatcaaaagttcaagcatattgagcgctggtatcatatcatacatgactaccttaaaaaaaaatatatcaaggtgcaaagaatagactccatggataatataacagactcactaactaagccacttagctaatagaagattgaagcccatcttgagaagatagggcttagatatatggcagattgactttagtataagtgaaagattattagatgtatgtcctagaagtcaatctggcttacacatttattttttttaggacatagtttttacttgatcttattatttattaataagattcgataatttatttttattcatgttgtatacatgtccatgaatcatttaagaaattaataagatgatgatatatattctcaaaagttaagaatttgaggtatgtattattgataattaatttttaaattactttcgattaatggatcatcatggagatgatgattgatccgattagattgatgtataaattatttttctttagatagatgagtcttgagtctacagtatgggaaactgaagtgagagtgcagatggttgttagagaataaggataccgagtacgactaacataagaagtcatttgaatatctactcactcatcaatgactttcttgatgctgtagtggtataactagttctttaacctgcggtatctcaactattcataatgaagttgttgcagtttgactatacatacacttggtccctagctatagattttttgtggtgtatgttggctgcagtaggttcattgtaggagtaagatatgcttctaaatgagatctatcgatcttggtagttcaggagtagtcctatgtgatttatgaaattgagttctgaagattatggtcatgacaatgtgaaaaatgaaaaataattttttcataagattttacagtatgaattcgagttgaataaatctcacatatgagagatgataggatttgacaagtttttcataacctctatcttatcgaaattcacaatagaagtactgtattatatggtagctatgctgagttgccactatatgctgctaggcatcattagtagattgtgagaccaacaagaattattttgatggtcaataattcttgttaggtgaattagaactgttttaattcattaaaaggagtttcaatgatattagtgatagagatcataatatatctcactaccaaacagaatagaatttataggatcatacacttaagaggttctaactaattgggattgttgaattgtaatttcaaatcaccaaaggatttgattgtcaatatgattgatgattggactgatttataaaagttacaagagaaaacttgctaatagttagtgagttaaagaagggcttatttataattattgctacattatttgatttgatcaaataattggggttgagtcctagtcaatttaaattaggatttaatttgattggatttgatctgagtttgaattagtttggattttataagtccaaaaggatttggactcaagtttcatatttgatttaattattctcagaacccaaaccaattgggatttgaaccaaccattgaccaagtccaaggagagatcatgcctcatgagaaatcacgccaactgtgttttcatcggtggtttttctttcttttgcatggagttagtttggcgcaacaaaaatatgggacgaactccttccaaagagtccttgcatcccaagactcttatccctaaccctattggaatttgatttggatatggattagggtgtggtgcctcctcttatctcatgcataaaggagattggtgtgaactaattggcgtagaacaaggcaaataaaaaggggtaggggcatgggtgaggagttagcgtaaataaaaatcagatctggatgccttctttctcttcctctttctcttgcacatccaaagtattagatgttctaccctacatgcctctcctctcccattctcctcctctggtttctttaatattctcttgagaagagaaaaatgagaaaaaaattcaataattcaaggagcgatctctacaagagagctagcatctcgatgagatcaagatcttttgatcagatcaacctcatgtggatatctgtagaggtcagacacatgtgcggtttcagaggaatcttcaaaatattcatgaatcatcgaatcgtaatgaagatctacccacgcaagatgaaaatcaaaatttcctctctacttttgtttttatcttaatcttaattatgagggatcctagatttttgagatgcgatctcatgcctgcatgtatgatttaatctgatttaatttcactatattttaatttttatgttgcatgctaccagatttctttcactttcgtatgaataaagaaatatccatctcttatttttctggtgagtcaagttttaatcactgaactacccctaatttggattaaagaatagataattgtggccggcatgtgaagcatattatggtacatgaccagctttaattggttaatcagttatatttgagccatcatatgagatctgattagcaattagcatgaaaaaaattatacccaaacattactcttaatattttctctataaataatgggcaaagtgtgcaagcaattctcactggctaacaactgcggattggtctccattgatcctcctaatatgaaaaagcctatcgatgatttggccaggcataaaataaaaacaaccacctttttgtctaaagaaataattttatgtttattatttaaatatattacttttggatttattaaatcctaaatagaaaaaccatcacattgtttcattaaataatagtaatgccgttgtgagatctttaccctcctaatttcaacttctatctcaaccgatcccgccaaaacatggccacctagcagccctctagagttgatcataactcctaacacctccttgatatgaatattttcttgaaaaaaaattatttttttgagagacaaaagaagaaagtcgtacctatactttaaggaggtgtttgattgggggagtggagatgtgaaatcgaaatcagaatggatgacttccattccaatcgtttggttgagaggagtcccattctgattccgattccaagatagaatgagaatagctcaatatatatagaactcaatccctactctcctctatggattcaaattttcattccaatttcaatttcgattctgatcacgaaccaaacattttggagaatttggccattccaattctgatttcaagcccttccgatttccattcacattatgattttgattacgaatcaaacaccccttaattatctaaatttaaaagttattgaaaaaacacccccagaaatggaatatacaaattttggttgataggaaaaaaaagcaaagtagtttgacgattggggcacgacctaattcataatactcatgaaatttacattctacgactatttctaagacaaaacccaaaaaaataattaatgcaaagtagagttaaatataaaaattctaaataaggcattaaaatgtataaagtttatcatcaagttgtaaaaatataacaaaacagcaaatctactttcttgtcattggtaaatcagctttttcaatgataagggcattattattatttgcttaaataatgtcaatatactaatctaggtttagccaacaacaaggattgaattgtcaattgcattgcactaagaaaagaaaacttgattttaaaaagagagggaaagtgtggttgcggagaaaagagggagttcaaacccaactaggagatgttctcgacatacaacttggaacccaattcaactcaaaagattaagccattaaatttaggatccaatcatctatatcaatccacctattttccactaattattgcatttaggactaaacatggatcctcaccgagtttttggttcatgtcccaaaatcaggattaaatcatgaaagttctaaaaaatattaatgtagagaatattgttgctgaggtcatgaaccttccgctaattatatttttatgttcttcactctcattcttctcagaccaaacgaatcagacagattcaaggacaggctgcaaattaaagactatagtaaatatggtaacgcaagtttacaagcttatgcgccggcttataaagaagatgatatgaaaacatcattagattatggaactagactgtcaatctatgtttagattacatacagtccacattccgccgaacaaatcattagccatgatttatctggctcttctcggcatatcctagcatggtgattgatgattgcacatgtctaattattgatgcaagttattataaaattacatatttagctatacatcattatatgtgcgacacggagagaagagaaagggaggaggggaatctctccatacagctatagctcaaacaaggactcctatcaaagtggctgttgagtgggcattaagtagggatgaggggaaagagacatgcgtgcatgacggcagccatgtgtccagaggaatcccgactggagaaccttcgtctgtttcccaccatttccatgctctatttagcactgctaaccgattcttccatgtgctccccaacagacatcccttacttgtttccctttcatgctccatatatctccaccctcatcagctgtgattcctatcaaactacagtactagaaatctatactgccaccactcccattcccaccccaaaacagacggtagagcctctatacgacatgggtttccaaggaaggattcaaggctcctccgaaggccactatcagaggctgcagaatgaagtcgagaaggctgctgtaagacctcgaaggcgatggctgcggaaggtgaagggcaaggtgatatcctttcgcgcatccccttccaagagggtgaaatggatgcggctcgtcgtggtgccgagaaggctcgcagaactatatgccgagattgtgaaaacaatgcgcatggatgaagtctatcctacaatcatcttctcttgccactggggactgccggtgctctctcatcccacgattggctgtaggaagagcgcggtctccctacacccggaaacctctctttctcgtggttgaggtgcatatgtgcatcttttgtaacattcaggatgaattcaatattttctttgatttgtttctatacacttatttccgatggcaatctatctagttagatggttcccacctaggtatattgtaccatatctagtttatagatgactactatatagtgtatcattttccttgatgagtttccacatcgacagcgtgtcttctttttataaattgctctgccaggtttgaactactcccgtcgccttgcgtgctcgaactggttccaagcaaaacttttttttttttgattgcttggttccaaggactaccatgtgtgttttttatacgataggaggggtttcctgtatttcccctgtattaaattttaaactgtcaagccccagcgtagactagtttgtgcaataacttaatagtggttgtaagctgttaccaattttttatttacatcacatccttcagttttcagcagagaccacactgttattgtaacctttcatgtctatcctttgtcccccgttgatcaattatccaacaccccaaaagggctctgccctcgcacactccatcatccaccgctagtagccatcctccccctattgatctcagcctcctcccattctcctatgagctcacacttagtccatcgattcgagccctctcgatctcttttgccactcagctcttccagcaatgctttaggatgcatttcatttgcaactgaaatcaaaatcaaaattaaaacggcgtagattaaaacaagaattggaacaatcatatcccctaatgtgtttagttcatgatagggctgaaagtgggccaggctgggccgggctataccccaacccaagtccgatccgaaaaaaaaatttcgagcttcagatcgggattaagcccaaatattttagaaaacaaggggtccgaaccaagcccaagcccgattgggccaattcgagcccgatcaaggcaagctcttaggtcaccaccagcccgtgccatcctttctcccccgctgatcacccccataccctaatcctctgatccatcgacctcgcaaagatcgtcccgtcgtcagtgatgacgatggcattcacggcgtcctcatgcgccgctgcagattcgatgcaacgaaggttggaggtgcaccagatcttgagggttttatcttaggagatggagtagagcaggccaccggaggtggtgatggcggagacggtgtcggcgtgttggatccagaggagcttcttgtagcagtggatagtgatatagttggaggggagggggaggtggtggagacagtcgatggcggtagagagggaggcgaggaggtggtagcggtcgtagcactttcaggtgtggatgcggccatcctgatgggcggtgaaggcacaaccatcaagagagaaggtgacggacttgatggagccagcggtaggggcagcagggaagaagtcgaggtggtggagggagacgaggtcatatatggagatctcaacagtggaggcagagtagaggagggagggtcctgcaatgatgatggcggcgggtgcttcgtcgggggtggggagggagaagaggtagacaaaggaggcggaagagggaggggagtctagaagggaggaggcgagggattggagggaggggagggtgatgtgggaggcggagtcgatggtgaaggaggtggcggcggtgccattggaggagctgtattcgagaacggtggacaaggaaaggtgtaggatccgagacggcagagtaagaggggcggttgggtcagcagtggtggtttggtggaggaggtatttaggagtcggacctgcgccgggccaaagataagctcgagtccaatccgaaagatagaccaaccctatatttagacccacatccgatctgaactatttcggaccgagtctgaagttcgatccaaagtcagcctgatttaatgggcctcggaccggtccaagcctagttccagccctaattcatgaccataatcaaaaagagatttgaatactatgggagaatgattagattaaattttgaagaattaggatgttctcatccccctggaattggaaagagagttcctccaataaaatggctgacatgagaatcacttattaacattcctatttcagagtctaactccccttaaacaaacatgcccttagtttcttcgtaaccctagtaactctttttagtccatgcttctccaattcctctaaattatgtcttgctcgtagcaatcattggctatgaaactagcaaaatagatattcttatcgccactaaaataaaaatattgatcgatatttttatgaaaatactgataattaattgatgacactatcttaaaacagtacataagaaaataccacaaaaatattgataaagatatttatggcattttttctgacatatagcagcacttaaaaatacaggtaatggtaatttttgttatagtgttaagaatttcacaaaagtttgaccaataggctggtatagattataaggtgaattctattcttaacacttttcgcaatttcttagttccactattttggagaactttgaaaattagatcacatgcttctttaggaattatagtacttagcagacattgattagctttacatcaagaaatctagttcgtctcaacattgaagatcattggcccaatttgccaaggggtagctcgaatactgaagaatactaatacttgagctattaattgacaaattatattgagaaagacatgcagaaaaggcagacaaaaagccatgattattaatttttactaatacaattacataaatacaagatcaaatgggttagtactttcaaggtgcccacttcattctaatctaagctaatgcagtttttcaccatcaatggcttattggggtttaagtctgctcactatacatcatcatcaattgtagtggagatagactgagtgtagcgagattagagcttaggtatggatctagttgatagaagaagccatgcagagggatccacttgaaccaacttgaagatggtgatggaacactatagccaaaagcatgctggcacttgctgacttagaagccttgaaccaagaagcaagatgctgtgatggtattctaattcgatgacatcaccagttcgtgaagacatttcgatttctgatagtattccaatttaataaaccagttgggagttggttggtcaaaacaaactagttgccagccaatactcagggtcacttactaccataagggaaagaagaatagagaaaggcataaagctggctaggaagaagaagaatgagtgccagagataaggatacaaggcctatagagtcgaagaattccttttcaacaagtaaaccaaaatccttattaatacagaaaataatatcaaatcctaatggatttggaggatgcttcgagtagcgcaggccgttttggtatccaaaagcatttcacatagagggacatggtaggagagaaaggcttagtggaatcagaagagatacaagcgaattgccgaaggtaaatattttgataaaaggacaatccttagtccgtggattaaaactataattataggattttaattctatgggtatcaaggaggtgatgatggacaacccattggcctcatgatccttggctagcgagatattgagggcattgttcacactatatctcaacaatctatgtggcgatcaggagcaagtaccatatggattaagttgatcaaatcaaaataagaatcctgtctcttgttaaccttagatagtgttcactgtgaaaatcatgcacatggtagagatccaagctgaacaagtagaatttggtcattagtaggttaaaaggtcaagtcttgctgtgaaagatggccggaagaagactgaaatgatcgtaccaatctcaaacttcaaaaagtagaggattcccttataggccgaataaagagagatggttaacataagctatgtcaggatgacttgaaggctgataaagcataactattaatttgatagttacagaatgatcatgtttgtgcatgatggaaagacatttaacaacaactatcaaaacttctagaagtggagattagacataaagagcaatcaatggaatgagttatagtgtttgtggatagttattagggctggaactgagctcggaccgatctaagacccatcggatcgacccgacttcagatcgaacttcgagctagatctgaaatagttcaagttaggcttgtgcttgattataaggcttgtttgtcgtttgggtctggctcagatatatttttggtctagctcgagtctgattcggatctatatccaagtttgaagtccagtccgatcaagagcccgaatgttcggcccaaacccaattcccaaaattattttttcttgatgtctgaactctaaaaatgctaattagagcaaaaacttagaattgtcatattaattaaagcaaaaacataggattatcaaattaattaaaatggattagaggaaaatgtaatgagaaaggggaataagactttttcttgtgactcttcgagaaccttctccctttgggcctcctccccctccattacctttcatgtggcggcggcctccaaccaaaggctcttccactcttcaaacaccttcctcttcctctccatgatctcaacttcctcctgctcgcttacttggatccttagctgctcctcttgatcattagaccatgcctttttctcctccgtcggtgacacagtgctcgtgggtgggtgtaaaatgtgatggtggccgcattattgagatccacctcccagccactcatctcatgggccagatccccatcagaacccttggcaacctcaccgctctccaggtggttagcctctgccttaacgccctctccgatcctctctcgtcaaaccttgttggctgtaaggagctccagattgtctatctctaggggaatcacttctccgacaagatccctgccggcccattctccctcaacaggttggttctactcagtcttgtcatcaataacttcactagctggatctcgtctggttcaacaaccttacctatctcgagatactctacctcaagcacaacctcctcatcatcctctactgaaggggaggagggagcaagcgggcaacaaagacagaggtgccaaggaagtcgatggagtcagagatggattatctgcagaaatcttgattgaattgttccaatcggattcggactgagcatgggcctaggcccggatcaggttcaggtttgagttttttaaaaactttcaaatctaaatcccgcctaaagtcctaaaaaaaagtttcaggccaggctcaaccaagggtgtggctcgacccggcccaacccacttccaaccataatagatactatatatcggtatagataagtaaaattgtactctaaaaaaatttttaaataattaatcaaattagtttatctctacctttatcttagttatttgtcttagaagtaaatgtaacttattttttttatcatagtataatgccatatccttctactatagcctagtgctatactcatttccattgttatctccttcaaatggtggtgtgacggtagtaaaaattctgaaaaatcaaattatcttaatccatgctgctctttatctttcattctgccaacatcttttcaattagcccaatgtgatggcacatccgcacatatattcatgttttgcttagttaagcttggcggactatcccctaccctaaccaattgagctctttagagatctcaagttctttgattcattcggaacgtgatggaaaaagtggcaacctttctcctcttccatactctaaagtagaggatgaaatattagactcttgaaacttcatcttgtaatttgaattttgtggctaaattttccaatctatgaattttttttaaatttataatttttcattaggatttctatccttctcaaattctccaagagtcctggcctgaaactaggactggctgtcctgcacgtatgaaagtcaagcttacactttgtagcatattttgagtgactaaatttattccagaccataagcatccccttgcagacccattaatggctcgcagattgagatcacattgggcgaagtctaaaggtaagactgaagctaccaataatcaccagtcgaggcacatgtagatgggtgatgcaggagctgcatatcagagaatgcaagttgggaacccattcttcttttatgcagtatagatagggctgagcaaataatcaaaacttaaaaaaatccatctaatctgatccaataaacatcggtttcaatcagttgaaagatataaattagatagaatcggattgatatttgtaaaaaatcgattatttacggtcggattcgattcttacatttttaacccatatgagacaaaatgcaactgatgtagtatttcacaaactcactttcatttttgggacagcatcatttagacttcaatactttattttaaaaaaatcttatcacctatttggattcatcagaatattaatattgaattattgatgaaaacacatcaatttgagataattctaaaatgaaagctctcagatgtagttattttcagatgaataaatcttttctatttttgttttattttgtatagattcaaaaataaatctaaaatttgtaacttataagatttaggtttttttttatattaaattgataaaaaaataaataagcttaagtaagtcaatattagacttaagatcaatattggatcaatatcgaagaccaaattgatataacgaatcgttcattttgatttcaaatgatttatatatgataaatggtaggcaatgaattaaattttctgtaatttatttgaaattgattggataaaatttttttcttagcacgattgaactcgatccatgctcaatcctaaatacggatcggcaagctggtaacatggtcaactttttctaggccgatgacaagtccacgatggagtacatttactttggcgttgtagtatgcttggacagaacttacaaagcaaatgattatggcaggtcgttggctttattcgttggcgtgaataatcataagcagatgcatggttgtctttggttctgtattgcttgatgatgaaagtggagaatcactcaagtggctgtttgggatttttaagaatgcaatgcgtggcaaacaaccgaaaacgattctgacagatagatgtgaagaaatgtctgctgcagtagctatggtgtggctgggcattgtgcatcgtgtttgtgcgtggcatgtgtaccaaaagctaaaacacctaaataaggtctttcagggttcaaaaagtttcttaggtgatctgagtcgatgcttactcaattatgaagaagcggaggaattcatatcagcatggaaaaagatgatagagaagtatgatcttagtgacaatgaattgctggctaagctatatatataatgatcgggaaaattgggctgtgccttatggaagacaggcattttctgctgacatgttcagcactatacggaaagagaacccagttagtgcatataaaaaggtttttagttcagaacaagatcttttctgttttcttgtgcattacgacaaattattggttgagctaaggtgtacagagttgcaagctgatcttcatgctagtcagaataacttgaaaccgccttctttgtgcatgttgaggcaagctataaatgcatatacacctgcagtcttcaaaatgtttcaaagagagcttgaaatgcacgtggattgtacatatggcatattattttggtgaagctgggactatattagagtataaggtgacagctgacgagaaatccgttgagcatatcgttagatgggactcagcagattgttcagtttgcttagttggaaaaaatttgaatttgttgggattcaatgtcgtcatgttttgaaactatttgattacagaaatatcaaagaacttccaccacggtgcatcttgaaacggtggagaaaagatgccaaagtttggagccattaaggacaatcaggaatatacatatgatggtaattcaaagttgtttgcagcaaaccacgttagttatttgtttcgcatgttcagtatgattgcagcaagggccgcaaagatgatggaggcatataaattcattgaaagccaatctgatctgcttatggaacaaataaaagcacattttgcagaaaataggctctcctgagaaatgacacctgattttctcttgagcaaacaacaatagatcctgtttgacatgcaaagatctatgtaattatttacgaccctcatggaatcacaaccaactacatatttgaaaactacctttacaatgcagaactgtcattcttcctccacaatatacactgaaaaagaacatagttctcttcttgattcggaattctaaagagtcccaacttcaacgggactgggactcctcatctataaaaaagctcaagaccccaggtatgaagatggaaaacaagctctctacttcccgttctactttgtttgttctacatctcctattccctagagtcttgtctaacttaagtattgaaagatctctatctggatcatcatccggcatagtggtttgatcaacgccctctacatcttcagatcatcagactgggttttggtgacaataactttgacatacaagacccttgccaacacctaaaactcaatgcatgatgttaaacgggatgttgaccaccccaatatccactgaacttgtaatcatagatccttagaatccgccaaggtacctagaatttacctaggtctgcatggtgtccatgatgcaaaggaaaattaagggtaatcatgagttcatttatactcgagaaaactttcattaacttccggtattaaaattgagtgcataggagggcatttacaggcttggaggcctcttacaataatagggatggacggatagctcgcccaggtgcatttctaaagaaaaattcactttgatgagagattattgtcaaattggtttggatggtcgtcatgtcaccatcaagttgcttctaatagtggtacaagagccatttgattccacaattccttggttggcttggacttagatgccacatctttgggtggcgatcttggcacagtcaaatggtgtatgatttcacctctagaccagattaagttggcctcaaatttgattgctttggtgcacttttggaagcccttagccagatgcttttgatcgtgaaggcccttttgatggtgagtttttgctgtcagatgtcttcaacgacatccagcgtgctatcagatgatggattcaaccaaatgcctaagcatgcagtcctggcctgcattactcattaccggtacatttattttatacaaacatagccatccaaaaacccatttagactttcattgatcataattttaactaaaagatgatataaaaaaaagcaagtaatatttacttgttgtgttaatgtagtgattggatggagctagtcccttctcttttctcaaaaaataaaataaaataaaataatgcacaaaaaatagaatcaattttaacttcaaatctatcatcagaatgacaatagacttaaaagtttagaatagatgacaatcatcagctaattaatgataaaactaacttaaatgcagtctcataccccaaagtctgtcaatttttgtatgatgtctggaagttttgattggatcaccttggttgggccatcaagtccagggctaaatctaaatccacctgtttataattagactgatttgggaaagacccacccaaaactatttactttggatggaaatgtgcaggttggtgagttattttggatgaattccaaactcgtcgataactgtcgaacttgctgttgaaattcatttcttaaattcctttcttcatttattcggttcctagtggaatggaaatgatctggtgcgtgctaatgtgctccactcaaattctggaaacatgaattgtaaagaaattttatgttgctaagaaattttacgttgcaaaatcatctcgcagactactctagaactgagtacataataaccagtactgatcgcctagatgcttctgcttgctgttgaaattcgtttctgtatttctatatgatattagtgaacaatattttttttggtatcatattagtgaataataattgtaaacattgttgttggtcgtacccttttaaaaaatgtgacatggttattgaattttatatttattatctatttttaaccactgaccgatgatggattccacgcggaagcagcgcatgatccaatgagagtcaaagcaatacaccgccacccgtctcatgaacgtctttatactaggagctgatgtgtggccaaggaaagtccataggatttttcttggtacatggtacagtttatgccgctccagcggatagctagttgtgtaggactgttgtgcctgcactttttttattttttaattatttttaataataatttatttttaatataatggatgggttgacaaaaaggtagataggaaaaaaaatggatgacggaaaggatcggttccgcccatccccttatatgtttgataaaatataaaaaaataaatttaaataatttttttatttgatataaaaaatgatagaaaaagttaatgatatttatagatatttttattaaactattatctaataaaaatattattataattaatttataatatttatttatattaaagaaatggagcaataatatgaaaattataatttttataatttataataaaataaatattcaatttaatttaataaataatttataaactaattaatttataatttaaataattattaatttacacaaaagttgactaaaaataataaaaaaatagaaaataattttaattatcaacttataattatgaaaataatgtgataaaattaaaaatattattaataaaaagttaacaatatagagtaaatagagataaatatatatatatatatatatatatatatataattaataaaaaatattatgattttgttaaaaaaaattaataaaaatntttttatcaatataaaaaatttatctctcatatgtttcatttattcttctttatattctttctgtttccaagattataaaacaatggatttggataggtagattttttttatgttttaaattttttttttggatcaaataagaccatccatccttatccaatcaaatacaggattaacgcgaagatggaaaagagtggataactgtgggtcataaaatactcatcctgaacggacggatggcccgatggttgcaaaagatggcaggaatcccccgtttgcgcccgtgccttccccactaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccccatcttttctatatgtgcaacgctcctgtccgtttccgtcctggaccgtaatcgctaggtatttccaaacaccgtgcaaagatagattagggtttcccaaccccatcccaattccatccattcgacgggagataagatgtcgtcggacagcggcgtggtgacggtgtacggggagaccaacggggggtcggcgctgacggagctgggggtgaagaagacgtcaacgttctcggtgaaggtagggctggcgcagatgctgcggggcggggtgatcatggacgtggtgaacccggaccaggcgcgtgtggcggaggaggccggggcgtgcgcggtgatggccctggagcgcgtcccggctgacatccgggccgggggcggagtggcccggatgagtgacccggggctaatcaaggagatcaagcgtgcggtgaccatccccgtaatggccaaggcccgcatcgggcacttcgtggaggcccagatcctggaggccatcggcgtggactacgtggacgagagcgaggtgctgaccccggccgacgacgcccaccatatcaacaagcacaacttccgcgtccccttcgtgtgcggctgccgcgacctcggcgaggccctccgccgcatccgcgagggcgctgccatgatccgcaccaagggcgaggcgggcaccggcaacatcgtcgaggccgtccgtcacgtccgctccgtcatgggcgatatccgctccctccataacatggacgacgacgaggtcttcgccttcgccaagtgcatcgcggccccctacgacctcgtcatgcagaccaagcagctcggccgcctccctgtcgtccacttcgccgccggtggcgtcgccacccccgccgacgccgcccttatgatgcagctcggctgcgacggcgtctttgtcggctctggcatcttcaagagcggtgaccccgcccggcgcgcccgcgccatcgtccaggccgtcacccactacagcgaccctgacatcttggccgaggtctcctgtggcctcggagaggccatggtcgggatcaacctcaacggcgacgccaaggtcgagaggttcgccgcccgctctgaataataatacacatgttattagacagactgcaggcaggcagttcgttcgacttcgatcgatggtatgattatggtgacggctcagctcagcgctgctcaactcttgcccatttgccttctctctatgccatgattttgacatgcttttcgtttttttttcttttccatttttcctaggtattatgtcaataaagttacaatctactcttgtagcagctacagctaaaaacattgccttttctttttcttccatactggcctgtctgtctgtgtctttcatgtgataaaaccctctgctgaaaagaaaaccaagctggatcgagatttgataatttcaaaacaaattcaagaactacaacctcaaattcaaaaatgtgaaatttgaattctaattctctcagatgattgacaagaaaaccgagctggatcaagatttgaaaattctgattatttcaagtgatggttacggaaactgaactggatgaagatttgacgattcaaaaattaaatccaacaaattcaaaatttcaattctgattctctcatatattttccacgaggtggacttcacatgatagcagctctaaatcatcctattttgcatacatgatattctaaagttcacgatatttatagttttatgcgtaagcctttcttttttcaggatgattatataaaactgcactgcgtgttaatagctggcaaacttgtccatgacccttctcatgcactgtccgtgagatccataagggactgcttggaacgctgcattactaccctgtttgggtactccgttttggaatatggagcaacatatactcaaagatacgataacataacctatcacattattggttgaatcaaagatacgataacataacctagtgtttggatgtgcaatcatgagtacagcaggatattggataagtagccagtgtgttgttattaacattactatctggatctaaaattatttcaagcaaatctcttcaagttttcaccttttagtaacagaacctacctgggccagaggatacatttggataccacatctacacatacccagcatatacccagacctactacgcgcacttgcagtacactgcatgaactatacgttacaaagccataataccaaaaaaatgtaggatgaggtctatagccaatattaaagcagcaacctactacaacaattgctctagaagaacaataatactaagaaatcaagcaataatactaagaaatgaagcaacaagaaaaaagaaaaaaaaacagatgggatttggtctggtgactgaataattagaaatgagatctcgaaaactaatagcaagaaacttgtctactaaattttagttacatgactgttattataatcacctctatattcaggttacaacaaacccaaaaaggtagcaaaagcaccataacaagctccaaattatttaacacattggtgtttattatgttaccactgaagacatatctcttcatgcttcacataaattaggtgtccaattagggttcttaatgcaggtagagaaagaagaagagacccagcacgactatagcaagaagacttgttcgatttgttcatgccgccatattcctgcaagtctgggtatgttttgatgaggttaaggtagagcatgcaacaaaaattacatatggatggacttctttcctgttataagaaaattccagataatccactgaaaaaaacaaagatgaataattcaagacagaaattttgaaggtacaaactccacgtaaaaccaagctcattgcaattcaggtgcgcaggaggctcggcgattaataatgtcatagaaacagagcttaaaggtaatactgggactggattgaggccttgcaacaacccaaaatctcttgattacaatcttctttgaattgaagtgtatctttgatacagtggattgaggcaaaatagttcaagtttgggtttgaaaaggatggggagaaaaaaagaaaaaatgaaagtgcaactatcttttattttcccaactctcgtctttgttggattctctccattaaattttcatcatattgaagaacaagtgtgtgctgcccaccatattgaatgacaagcatgccgctttctcctacagcatatatacctttgactgaaaaacattattttcactgctccatatcattgttacttttcatattaccacaagaaaaacaattgaactgtcccaggggaagtttcagaagataccaatattatttgaaacaggttggagattttcattggtctttatgctgatagaagaattaaaaagagatctaattttgatctccgagtaaaaaacttataacttacactacttgtcactccatagattaaaatcaaagttcaaaaaaaagtaaacatttaaactacttgctagttaagacatcgcaatgttacttgataaattttatgttaaactaaaagttccaagggacatttgattcataaccggaattagaatcggaatgagaatcagaatcggaatggccaaatcccttgaagcatttgatttgtggtcagaatcggaatacaaaattgaatctttaagagaaaatagagattgaattttagagagattcgaccatttccattccatctctgaatcagaatggggctttttccaaccaaatggttggaatgaaaattatctattcttattccacttccagatcttaactctctcccactgagttaaatttttaaaactaaaaaaagtagtacctttgtttggtgagttctctttagcaccaagaataggaaataatatactttagtgaaatcaaagcctttcacgtactgtaagaatttgatccctctggaattggacatcaccaatgaaattgtcataagaaaagggagagattaggataggctaaacttttgtgaaccttctaggatatattatttccttctccacttctccatttccttttatacaaaagcacttatgcactaaattgcttccggcaatactcaagttagagagagccaccaataactttatttagcacacaccaaaggggagattgtaacttctttattgggaaccatatggttttagcaaaaagagatagatgaggggagtctatttacaaatctacatagtcaactagatcatttgtataactagagatgtggattgctaaacttgtcagcaaatatataagttcgatggttgatttcaaagtccttcaagatcgacaccaaatattttctatctcttcatcattcaaaggtgcaaagattaggaaccaacatagacctgatagcaagcggagattgatctagtgctctaatatatttcaaccttatgctctacaattaagaaaactaaaatagtgatcgaagaacatcacatagtagtagtcaaaatgagtgtatagggttttaggagtttaagatttagggttttagggcttaggatttgggaatttagggttttagggtttagaatttgagatttaggaattgggatttagaattttagggttttggattttaggggtttaaattttaaggtttgagatttaggatttaggatttagagtttaggatttggggtttaagattctgaattttggaattttggatttagggtttggggtttaggattttcggtttagggcttaggatttggggtttagggttttaggctttagtgtttgggatttaggaattagggtttggggtttagggtgtggggttttaggatttaggatttaggattttgggtttcgcatttatgatttagggtttcagatttagtgtttggggtttaggaattaggatttaggatttgggatttggaatttagggtttagggttttaggattaggcttttagggtttagggtttgggatttagggttttaggatttatgattttagattttagggtttcgagtttagggctttagggtttagggtttagggtttaggattctgggtttagggttttaggttttaggatttaagatttagggtttagggcttagggtttagggcttatgattttgaatttagggtatataatttaaggcttagggtttaggactttggggttaggattttggatttcgtgtttagggtttagggttttagtgtttagggtttagggttttagggtttagggtttggggtttagggtttaggggttttag

SEQ ID NO: 8219 - DNA, 34270 bp, Elaeis guineensis
  shatterproof1 (SHELL) shell thickness gene
  modified_base (1)...(34270): n = g, a, c or t
gtgaagtttagatactacctgggtagcactatcatcaagctgccatgcattgcactcattttaaattgagatgactcaaatgagtgctatgtgtctccaaaattatagatttacaactattaattaatgtttttaaattttaacaaatacgtgccaacaatcaaagtaacacatgtccaatgggagtatttggacaggggttagcatcatctggctgcctgcatgtaagtcaatatgtatttaatttctaactatgaacaacttaatagactcaattgttatggttttcgtggcaaagctgcagacgacatgggcagacattatttttgctagactaaagagcagagagacgattgacggggattccatcatggtggtagcctgattacataaacaattatcatcagcagcagcgcatcttctcattcatgatagtcagtgtcagggagctgcttttctattgagattcgttatatttatcgagaggtcaatagctctactgactggatgatcttttatgtgactgagcatatcggagagacggtgtggactaagatcaaagatcttccttcgaccttcaagaatatttattttttaattttttttggatgtattcgtatgaataatctagcctatcaaaaaaaataaagtgacatgtggcctggcacaaagtcacgtgaccttgaattccaacaagcattttagattataagcttacaccatgggcgagggaagttttccacattttcttgctacttctagacgcttggcatacacttacatgtctaaccaaatctcatagtaacagcaaattgcttgaaatacagattgctctatgtcaaattctttaggctgcagtgagaaaggagataggcgaaactgaagaaggggtggaaaatctaaagttccataccaccagttcatgcaaacatcactggttggtcagctgacctctaacaagaaagactattcacatggagggatgacccactgatgccccaaaacaataatgcaaacaaagagagggtcgctctctcacttgagcagcgtagggatgccagtgagtgcaataaagaagtggggacgaggtattagaatttcgatacatgtgtgcgtgtgtgagtatcacagagagagagagagagagagagagagagagagattgcatgaaagtcctcagagtatgggacatctccaaaaccaagtccaatatctagtgatgggctcttttatacaaagagtgatgcgcaagaaatagaagacatggaggtgagaagcttgatccatgcatgcatgaacatgatgtgagagagaccatgaagctgaagaaaggtccatagccacagaggcaataaaagaacatggttgggatgttaaatcacagtaaatggtgaaaagaacatggtgcaactataaggggaactagttttagtagttcatctttttaggaccacaccgcaaggtggacagttggtgttacatttagtctctcttcattctcttttaagggaaaatgtcatctagagtttgcagaagttttgaagttttacaatatcgcttaatttaattcaattgatgaacaataatatttagtgattgaaggtgtgaactgtaaggtcacttgaaatttagagtctatacacattgggagttcaaaatatctggtcaattttattaaaatgtattgttccaatattaaaattttctcgagttttctttaaaggactctagtgttcctttgatctaaaaacagtctaattttttgctaccacaaatatactacagtagaggcaaaaaaatctagataacacaaaggaacaaacaactttatgtttttaagcaagcaaataagtacatattcttccaacgttttctccaagaacatgatcaatagttcaaaatgtttgtcccttgatattctttacagaaaaaactcacggacaataagcttaaatcttcatggccagtatattttgtaatatatggtgaaactggagttcagttgttctacaatcctaataagatcataggggtgcaattcttgtgtccttacacttagggaaaaagctttatgccccagctagaaagattatatcgatggtcccggaggagtcttgatttagtacataacttctaaatgtggagcatcgcccaggaaggaaatatatccatattaacaaagtttgcaacatttggattggatgatagtccaatgaagaaaaattgacctactcaaccatgacaatggagctgtcctcctaacatgataaggacatagcaaccatactttggtgacattttaaaatcatgcaattacttcatcatgtttaccatggaaaattacacaagaagatggaaaacatagcatagcatttaccataaagaaccatgcatcgttacgtcatccaagcgattcaggtgcatgcatgtagattttcctctctttgatctatatatatatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatctaacttaataacgaagtcttatgtatgctaagttttccctttagaatacttggaaggcttgacagcatgcaatcattcaatcaaaacaagagagataatagattgtttcagagctaggcttttggaacaagtaaatatagtaatacaaatagacaatacaaaagacaacatttttgtttccagaaaaccattatagaattttctaagcctttcccttctaatgaggaacatgttcattgcaatgttagagctatatgactaacttgtataacggacatgccacgttagccttgagtgatcttgaaattgttgaattagtccaacaaatacgactatttgctgacgcctagcccaaataaaacagaattaacatgcagtctagtctgaattagtggcttccactaaggattagaatgtttctcctaactatagagcaagaagacctcttgtatttagcaatgttatccaagctggtcgttattattcctctagaattggctcccactgatcagctaccaaagttagtccacagcacatagtcccaaacatgtcattaggtttaccataaatttagtatttcttggtaaatagaggcaaacttgctgactgttcatgcaattaagttaccttgacatatgtgatgcattaattacatgcaaagaaaccatctatcatttggagcttatactggaaattgaatttcccgagagaatctatatattcatattcgttcatccctcgattgtattttcaagaaaagatttgaattttaggcaacatacctttttctctattggtcttaattttttacatttccaactacttaatgatatgattcagatacatagggtttctacccatttttcttgaaaagaaaagaaggaaaggaaaatccaatagaatttacagtgcattgttgaatctgcctaatctgaaccatgactttaaaaaaaaaaaaaagaagaagaagaagtttctggctacatttttatatcagcttataattagtttttattaatagtactcaccaggaaaagtgtaaatattaattgttcttatgtattattgcttttcttagtgtttttctgttaggaaaacaaaagaaacttgaaattgcactaactacaagtataaaaatgaaaaaaggtaaggccaatgttagagagcactaaggcttcatggtataaccttcaaaagttgtgatggatacaataccataggtatttgttcttgctagccataaaaatatacaagcatatgagggtagcacatggtaagtagacacaaggtatatttatcttcatgatatcactacaataacctgatgatatggtgatgatgttatccataaccttatcaataatttggttttgattttctacaaacagggatgtgtttttattctttttgaatatatatatatatatatatatatatatatatataaagaaaaaaaaccttggcaccggtagggcatcatgttaattaacagacatgataatgtagtactaaaagctacatctaatataattgtacttttactaacttgatgtgaaacttaaaattgtattgcttgggatcaccactttatgttgcaccacttttgtgtgttcttgagcatatctgcgcatatcctctttcactcgcattatttagatattaagtgcaaacatttaagaaccagttatccttgaaagacatttgagactgcatgaatgccatcagatttcttggccaatggaatgaagcaggaatggatgtaatgtgatgtacgtgggtagaagggacagcgttaacatgaaacatgtggaagttttaatattttgagaagagatacatgcaagttacaaaaaaaattaaaaaagaacatacaaaaaaaaactatttatagatgaaagaaatgaaaagaaagaaaaactttaaaagaaagaaaaaaaactttaaaatacaccgcaacgattaatttcttattcaccatgtcacctcttctatgaataacgaatcaagaaaagatctgtggcaggtattgccaagccaagcttcaataaggttttgttacttctagaatccaaactcccttgacctcatagttatgcgagagtctagtctattcattacttaattcccccacctaaccctaatctgagaaggaattattatggcttggggagatcacgtgcggaggaggcgccaccgatcgttttcactttaccgcgcgcttttcagtcctagcagtgcccccccagtccccaccacttccctgtcaactgctccaccgcaacctctcaatctcctaacaatcactccaataacgacaaaatgatggagctaacccatgacattttatatcgaagatatagtagcacaaactccatccggcggtacagcttacccagccaacccaccctccactctttaagaggaaacccacatatccgatgccaattgcatgcagtggaaagagagagagagagagagcgctgagctcccttcttttccctcggaatttgcggtgttggacttcaccttctcttccggcgtggaagctgagttcccggagtggtagttttttccttttttttttttttgagaacaatttctgtctttctttctttctttgttgtttcggcttttttgatatttgtttcctttcttgaggaatagtttttatgataataccggaattgggggttgctagaaatcgtgaggtgtcattgttataggttttttttttttgctggatcttcggcgatctttttgctgatattatccgtttttaacgatcggaacgttggttgcgtcaccaacaaaatgcgactttgttctcgcttctcgctagatttgctccacgaaaacagtagctttgtcggatcggatcgtttgctccatgtctagtttttagggttatcttttcacatgttcttgaatatatctttgtcaagaaaaaaaaaaaaaactttaccttttgttctataacaaaaatcttttcttccacgtattttggttgccctagttttttcttttttttgtttgtttgtatttgttagagaatcgagatttgagccgtacatctcgttcataaactgtttcatttgtcagaatttaaagaaactaaacttcacgtatgcatcgttatccatttgtcatgatcttgtctcatgaatatatgtattctgttcttgtcttcgccttaatttttttctcactttcttttccgaaccctaacccattcaaagttcccaccttttctctcttacttgctttcatgtttttttcctttttttttttgttgcttttaattttgcttgaataccttttgatctatggaaattaataagtcaatatgtcagtatgtgaaggtctaggccatgttagtcccatcatttcatttatagtttagatgatgattttttctttgttcttggcaatattctagaccaacttcagcagacagaggtgaaagagagatcatgggtagaggaaagattgagatcaagaggatcgagaacaccacaagccggcaggtcactttctgcaaacgccgaaatggactgctgaagaatgcttatgagttgtctgtcctttgtgatgctgaggttgcccttattgtcttctccagccggggccgcctctatgagtacgccaataacaggtatgctttgatgacgccttctcttccttcgctcatatcaagttaattttatggcttcatttgttctatggccaagccaaattctttttaaagttctagaatgttaatgatggtagttttgctcctcttcaatttatttgcttcccttttatccctgatccaaatggtttttttcttatttaaaattaccctttcaaattatcacatttaattcagcttttattattattattattgctatgagattagtttgttgttaagattctatataggaaggaatgatcaagtgatcattactttatgtagtaagaaattaacaagcaaaagcagcgtgcttggtcttaccatgaggatagaggaagagttttaccttgactagggcaactaaaaagggtttgagttttgcctaacattcttgttatatgaattcgatctgtacacgacttactactctggtattagaacgtatgtactaagaagttttcttgggatggaaagaaagaaatagtgaagtaaatcttattaatttgtctttacatgttcttctcatattttctcatactcttttcttatgttcagacttacaccgaaaaattaagatggatgatattatgttcttggtataggatttcttttccgacgtaccaatgttttgttaaggaaactttgtagttgacttttcgattataatattttccaaaggactccacgaaatggtaacatctccagtcgtttcaataaacttccgatcatattatgggtttgcatttaaggttttcttcttcccttcgcttcctctttgcctttgcctttctcgtgttacacttctggctcgtcaatctgcagtactctctagccatctctctctctctccatccacccaccccccccccccccaaacaacacacacaccctcccaccctgtgcaactaattccgacaaaataagggtctcccattgttagagcacctcctgtatggactgcattctaaagatacgggaaaatgagccagatatctattcatcaatcatttagtagagtctctaaggttcctttttaaaactgtcttgaaccggcttttgcacaaagagcaccactccctttatttataagttgaaccttcctgaaagctaacttgggtttcagctttcactgttcaagtaagtcataaagtttttctggtcattaaaccttgtgatatggagatggaaactgcttttctccctgccggatttctcttctggtgctaagcggctaaaacccatcatccatgtctgccttcctcttttatgggtagttgctggacttcggacaccggtgaaggatgaaggctctttgtgattggttatgagatatttcttgggccccgtgcctttgctgtcattccccacaactcggtggccatcatagcttttttgttagctttcgtccttacaaattcctctctggttctttctttcaccttttcatgcatttagcttcattgtcaacatcaagggaacacagaccggaagaagagcaagaagaacccaatcaagactggattttacaaatcaccaaaaaaaaaaaaagactggattttactcgacgacgctgcagtcttctctgctctcactcaattaaaataggaacaaggaaaatgtagatattttttcccttttcgttatgataattataatctaagaaagattttaaaagcttactgtaatcatctcatgttcaactattgtgttgcacccaacgaaatttctgtgtgcctcatgacgagcattacctttccatggttctgacacgacattgcatactagattttactgtgtacgtaaaaaagcactgcatgacatcatctctattcttcttcttcattccctttttttttttttttggtaatatctattcttctttaatgtcctctctgataactggtcttatgtacaggtacatctttacaagccttccgagagaatatgaatgcgtattttctgcaaccgagtatattctacaaataaaatgttagagattgtctcgaactggtatacaagcacattcctgtacgtgttgacatgaaagaagcatagatcagacaaaaataatagtacgtgacaaagatcataaagggactacaacattaggagggctacaattaataataacaacgggagcaactagcagtgtatacggttcagaccagatcagtttagagttatttttggaaccgagctgacttagttgtttttctaaagcctaaattgaaagagaaaccgattcaacctgatccgaaatactcgatttggtttcattcagtttatttgggttgatgttccatagtttgggctacattgattgcactaagtctaaatataaaaatttcattttatatagaattgatgttcaatggaccggactaagtttaaacatataaaaatatttaaattttgaaatatatatgtacatatacacatgtaggtcgggtaggtttaaatatagatacttacatataaatggattgggtctggttgggtcaatgcgagtctgcttaaatatatatatacatatgggctaggtcaaatcaggttagtttatatatatatatatatatgtgtatgtgtgtgtatcggatttgttggtttgcactgattttctaaaaaataaaatcgaaatcgaatcaaattttttctgttcaagagtatctcaaactaatttttaaaaaaaaaaatgatataactagatcaaaaaagaccgatttgaataggcactttatgattttgtcacttttttgtatacctctacgagcaacaataatagaaacaataataacaattgtaataatcaatataaaaattattaatagtaattaaaaaatatatacaaaatttttgcaagcattcaagtggacacaaatcaaagggcactaatgcattcataaaaggttgctagctttgatccatggtagcatcgtgtatcctgaatcatttgtaggttaattgaaacctcctaaattgcattttaaataaaaatagcatgcattttatgaagataaccttactattattaggtaataaggttgttaaattctaacctaattaatatctcctaattaagagataatagttgtggtggaaacgagatggagagaaagcacttcatctctcatctttcctctctaaataacatttcactaagagatttaattattggatcaaggctagccagtttgttatctttttttgttctagaagtgttgaccttttaccatttctcatatgaaaaaaaacattatctaagaagaataaattattatgatcatgaggagagagaaggggtgttaaggttattggattaaaatcaaactgattagaggaccttgtttgctattataaacccatgacaacaatcaatatgcactaaagttttggtataataagttatcatcaagggccaaaaaggattaactcgagaacacaagcatacaatttaacatcgtacatagataaattcaatttaggaggtaattattgatgtatatgcttagacaagaagaaagtatagaaagtaaggaaaattgcttgaatgatttagaagtgcataaatataatctaaatttgaggagtcttatttatattttgagaattagaaagggggagaaaattgaacaaaactttgataaattgattgtaagaattttcaaaccttaaagcgaaagtgatagtgaagtggaaccattaaccataatttgatattaaaaggttatctatattcattaatatcatttttttaaattattgtatatattttttgggaggaaaattatgttctttaaaagttagattggtttcgtacttatcataaatgataaatgatctgaatttagtttgaaaattatttgacatataacctttgataagaaattacatattaggattttatggtttactgtcatatagttctttgttttgtatttatttaactttgaccataaatgatttgaagtcaagatactttaattctagcctccccatcaacatgttgatggcttatgatttttattttttataacatttatttttatctataatatttttcattattaatttaatgaaagtggattacacgacatctaacttatatttttgaaaatagagaatgatatggtatactattttgaacatgttcagaaattagaatcttattattgttttcataaatttaaaatattatacttgtcaatatgaaacatattaaaaatgatctaaaatattttttaaaatttaaatgtcataggtttgaaaaattcttacttgtaaatatatgatttgtaactaaatatttttaatggcatgatattattttctaattccatcaaagatctagaacctttcaaattagttgaacttagatacgtgttttaatatgtcttaatcaagatcaacaatttgacttcttattttatatgatatatggtatattctcacttgatgcatctgtaagaaaatttaaaattcttttattttattttatatatgtgtcaatactataattcttgattatatggatttctagtacacttagattgtgattgttgtttggcattggaagatcgagacaattaataccataagtgggatatatacttgcttaacccaacattaaaccaaaatcacctctcgacaatcacacaaggacaagtgtactcaagataaacatggattgtcaagatatatataagaataataaatcatgtatataattttttttcatctacaaacttctcttctttctcttaatttagtatataacttccataccaatagattactttttatttgacccaaaaatcaatttaaccttttgtttttaatttaatcctttgtcttcttaaatgactcagcttgtaatttaaatatatcattacttatgcagtaatgtccatttgttgtaaataaatatttggcaatagaagaaatactataaggtcaaaaaatataaacaggacaatgaagcatttcgtatagtctattataaatgtagaatgaaacataataggcttttcatttgatctataattaaatataattatcaaatatcaaaattaatgtaccaatttatgagacatcaatattataaagggatactaagaaactaacgagagtacactgatcaagaaatgtgatcgaccagtgaggcatgttgtttataaattaattagacacgttttcaatttatgagaatttgtattcaaatatttataattgataaatggatcactttttatttgctctttatatttagactccaaatagtgctgtaagagaaaaaaatttgaaaaaataatttatattttcaaaaaaaatatttttatcaattttcattaccataaaaaaagatcgaaaataaaattaagaaagaatgagataagtttgataattttagacatccgcttgcataatagttcatgtttaatattaatttatcactgagaatgcaaaaatatataaaatttttaattaagctttgctacatataattattatatatcacttacataaatgatttgattaaatatttttaaaattttaatctaatttttaattgcatagatatctattgcagtaattttcctctaaataataaattaaactaagaaaataaaaaatatttaataacaattggaatatacttatcaatcctataagaataattcctgtaaaactccatccatttaacttgcatcatgcatcatttatttttttatttttaatcatttagaaatttaaaatcaaaattcaacttttatagatttattagaatgcatggaatgatttcataaatgttgcattgtactaaaagaatttatgataatctatacaagtcaagcatttaaattacttattatactttacaatagtaaactaccttttgagcaaaatggtggtaacccatcataatatgtcatatgataaataaaatgaagtacaaggctagataaagaagggggacagaaagagagatatagggctcccgagcttaagcaaccaagcaattcaatatagttgcaaccaataaaatccgatatgagcaaatataaatataactcactaaaagcccaaaatacacccaataagcccaggtaaccactagcccaaacataatggcctactaagtttgaattttaaagtttaagtctttgcccattcaccacctctaccttccaagctctaattattttaatgccattgcaaatcatcatgtcttctcttcttctaatttggtgtactatcattttcaatgtattgcaactctattgccaatcgatgctcctccaaggcatctctcaagatctcatttggctctattgcgctaccactaccatccatcctattactctctagatcaatatcaaaattaatgcagctcttttctcgatactttttgcatcatcatctcactccatcatcacagtctatacttgttatttggagcctatgcttgctactatattgtgacctcaatattacaatctctacttgttaccactcaatgtccatgcccatcttccatgaaagctacttggcaaacaatcctaataggttccaaaaaaccccacagctaaggactaaacacacaaccacacaggttctcttatactctctttatttagattcaaatctacatactaggctaagagtccaattctagtcaaactgaatcataaacatcataatcaatccatggtcaactccaaccatttatgaagcataagatcttatctaaaaaaaatcaaccaaaagttattatttggcttccttatccctatataagtatctaaatatcctttgtgtacaaccaatatcaaataaaatacatgcttgtgcggagatcctcacaaaaatatttagcaaaataatcctatcaatgttgttaggattgatgttgagtcataaatcatatatatagtggattggattagattcatcatcgatcgaattatagatcattagatctttttgaattatttaagatttttaaaatatacaagaaatgcaaaaattaaaagtataagatgaatatagaattgatgaataaagaaccaaaaaatatactgaactaaaagagagagtatgttggcttaaccaattgtagcaaggtagaaaccccactatggtatgtataacataagaaagaccgttattaaaagagaaacagatgcaaatcactttattctaagattaaaaatactatcttagctagctactttaaggatacaacttttacacattcactcacaaatcctagagatttagcaaaagagaaaagagagaaaaaagaggaaaggcaagggaagaatagttcctataatagaattttcactagttaataactcaagtatctctaggatgactacaagagtagctccaataggatatttgtaggtaatatataggaactcaattcttaaacttttcaatgtgggattccaaatttcattctaactccaataattgtaatgcaaatttttctaacaacatcaaaagttattaacaataaactcataacaattaaaacttttcaaaatttattaatatcaaactctcctaacttagacaaaaaatggatagaaaaataagtaatcataaaaaaactagttgacccaagtttataggatttgagacctatgtagcctaaacctataacccatgtggttagaacccacgatctatgttgttaggacttgcaacccgctctagcatcacatacatttaagaaatctaatttgcttccttataagttcatatatatggaatgtctaataaacaaatattgtgcctgattattcaagatctatatttgtaccatctgccaattaattatcattttatttagaatgtggttaaaaaatataaaaatttctcttttaagtccataaactccaatactatattagttaccttactaaccaagatctagaaataatttaaaatctataaaatttaatgaattatagaaattggactacataatccataatatgacattaaattctaatttcttaatagataatgattcaaagataaggtccggattgtttatggccattttatctagattgtaagatgcataacttgaatgataagattttaacaacaatagctcctattaaaaattaaaaaaatatttcttatatagttatcataaaaggtggtaatcaagtcatattatatttatcaaagcactgtctaagcaatagctacatgatactctatagtatctaagcactattctcattatctttatttctctttttaaaatttagtgagatggttgcattgcctccatctatgacttaaatttttggataacaaagccatatctattaagtttctttaatgaacatattttggctcaagtccattaggataaaaatcttttagagagcatgaaaattatatggttagaaaatgttactaaaggtgatttcatatgattcttaatgtctaaaatagtgtttaactttcttttctctatttttagtaaccaatgtcaacaaccttaatgaagcacttgaaaagatcgtctccttaataatttatattgtaagtttaaattttagttccttgaactattgataactaattgttacttcagtaactcatcaaactatttttaataattctctccatgattctcttacatgtccttttaaaatgcaacatgatatatcaatatgcttttctattagacaattcaacttctaattatgagtaattaaatatataatttttattaaaatggatctaattttttttggtttggcaactcttttgttcagcataagatcaacaattgataggtacaagaaggcatgtgccaacagttcaaactcaggtgccaccatagagattaattctcaagtaagaaagacatggcaatttaatctaaaatagatttctctgaagtccatatatttttgcctcatatgcttatcagttaaaattcttcatgctcataaaggcataaaagcaagtcagtaaattatttgtacagttgatctttttgttgtttgttcatagccttacatgtatctttgaatattttgttgatatattgattgcacagattttttttcttatttccattgattgttgcttttcttggatatatttgataggtttgattgagaatagtggattaaggtggtttacaacctttctttgagagttgtaagggtgtaaagggctagatctactaagagatgagggtgatgatactactaactattaagactatgtcggagtcctttttcttatggataacatatatttgaagttgtcattccttataatgtaagaggtaatgaaaagatttttcttgcaaattagaatcactttgcatcaactccaatacttttctttatgctaataaggtagtgaattttagtgatatcgtctaggaatgattcaactaatacctcattgcttttgaaccataattgcttttcctctattttcttttttttcatttcaatcatatttgttatggtgtaggagggaaggtatcattaatcccatattagttgtgagtcaaggaggactctgaaggaactacccatcctacatgaggtgctttttggattgaaatccaaagggataaaattttgagacctatgagccaaaacggacaatacgtaatagccgagccatgagctcttggttgcaacagtggcacactaggaaaggaatcacccttatgactgtgggatccctctcatccgtacacaaactccttgactggagggcggtaataaaataaagatgatggtaccttccgtctatccatagacttcttcttgactgggggctatattgtggcgtaggaaggagggcatcattagtcccacattaattatgaattaaaaggctgggactctaacttatataggaaggaaacactcatcctacataaggtgtcttttggattgaaattcaaagagacaatcatgaggcccatgggcaaaaacggacaatacttcacatgccaagccatgagctcttaatcataatagtggagggagggcatcattagtctcatattggttgtaaatcaaagaagatcctagcttatatgggatgggaccttttcttctctgtgacgccccatgccatgtcaatcaaagatcgaagtggataatacctcacatatacaagaacggagatcaatctacccgagccatgagcccttgactgcaatattgatgtgccagataagggacctcccctacgactgtggggcctatccctctgtacatagactcttccttgattatagagctatattatggtgtaagagggaggacatcattaatcttacataggttgtgagttaagagagactctgatttatatgaaatggaatcttctctcctctgtgaggtcccatatcatagtggctaaagatcgaaacgaataatacatcacatatgcgggagtgcagactgacccatctgagccataggctaacaatattatcatagaatcatgatttgtagtgagcattcatctactattttttttccagaactcatttcaatttatctcaattttcatgttttaaaagaaggatagatcttgcccaataatacatataatatttatgaaagtcctatgaaagccttattgtagtcagaaaacaaggtcaaaaatacattctagtctatggttgagaacttcaaccaattgactacgttgcctgaatgttcaaaagaattcaatagttcaatcaacaaatagagatgggatcatatcatctttttatttcatcaattttgctgaatgatatctataatatatatgtgccttcgctctaaaaatctttggcctaagttcagatttatgatagcaactcttcaaaaaaccaaaaattgtgatgacaactgttgcctaggcgacatgtaagtggttaagattgaaaactctaaaatagagtgcagctactctaggtaaaagatcactgacatagacatacatcaaagttcgtctgctccttaattatttcttttactaaagtagatgttgaatcataggcgaacaatactactgaacaatacatatttcttgcatacattggcttgactattagtgctatgcactctaggttcatttatacttcacaagagtttttatttgtttgccaacatcaaatttcatgcaatcaaaaacacaacttgcagaaaaaatgaataagagttaagtaaaaggacctaattatcataagctatggaagacaagacaagggatactgccattgatactcttagtaaaatagtgttataagtgatagtaatagcaatatgaagaaaagtatgaaagaactagttttttcttaaaagagtatgaaatgcatacaagttgcggtatcatttgtgaaagagaaagtattttcttttatttacgtttagtcaaaaccatatttatttgttatagctgatccctgaaatttcataactcacaccaattggcatgatgttattagcttagatttgccattataccgccattggtaagaacaaaatgccctcaataccaaaataaactgcatttgcaagttatttgaaagaagtgcaactctattattgtggcatgttaacgagcttttctataatttgaattttttgtaccgtctatgatggttatcaaattgtataacgaaggcaaaaaactatggctaaatgattcgtttttatgaattattgtatgctactcatgctatactttgtttgtttcatcatgatcattacctgcaaatcatctactcgcatgatacagctacgcatttgtcacattccgaacctagcatctgggtcagccatgcgatggcctcatattccctaaggcaaggctctaaagaatatacaaagtcttaacttctttacatcctcaaaatcacatgagcactattgatatcaatttaaaataaatatttttaattaataaataccaaactttatacaatttatagaactcaagtatctgattggtgttgataatgctccatctaattaattccttcaatcttgatctcaactataaccaaaaatacatatatcctatgactcttaaaaagaaaaggaaaagaggagatgtaagctttacaatccaataagaattttcacacaccaacactaatataataataataaataaaaaataagtaatagttgttactcttataagtcttctgtcacaagataccataataataaaacatgcaaagaaagtacatctttttatataataaatcatattaaatacttttctcaatttatagttactggattcgataatatttaggtactcgacactgaactatcacaatcatgtttctggctcatggcaagatatcgacatagtggctagtctcctaaactatcacaatcatatttttgatcagtggtaggatatcaacatgatggctaatctagagggccatatgtgcttaactctgactactacagctagattttcaatctatgatcagacactaataaagtagcttatctaaaggattataagtgctcaattctaaactatcataatcacattttcagattacggtaaggatcaatatagtggcttatcacacagactaccacaactatatttccagcttgtggtggggcatcaacaatattaatagcctaaagcaccacaacccactattcagttacacaattcaattaacaattcaagatcatactcttttgtaaaattcaatacacaagattatcgaaactactcaagttaggattagtgatatatgatacataacttcatacagatctctctctatatatatgtatgtatatatgtatgtgtgtttgtatacatacaattaacaaataagcacatagcatgcaactatcaaaaatcatataaatcaaaatcactatgcacaaaataattgttatataaatagatgatcaatgtctagaaatttttcgctctacgtactgatgacaaacttggttataactatttattagtccatgcctagcatgtccaatcaatcaatataatttcagttcatcctgaatcaaccattagcataaaaattaaataacttattgccagtgttttaatttcaaagctctaatattcgaattaatcttacttttaatttctctatactttctaattaaaaattacataattaaataaaaaatttggattttatcttgactataaactagagcataaaatcccttgctcagtatttcttaattggatgattggtcccatccaaaatcaaaatcaataattagaaagagccataaaatggttatcatcgatggtagaaaatttagaagaagaatatagctagtcgaataatagcatctggcaacctaagtgggtcaggtctggctgatttagctggttattcatgaatacaacaaagatcatctatgatagattttgaggttgcttgatcaagaccaaggtggagaaaggcaatgctagtagcatccagtgactagtgttagcccaatatacataatccaaatgattagtctacaaatcaaaagccaaattatagctcaataggaatttggtgatgataaaatcaaacaatgcttagcagggtcgggtttggagttaactattatacagaacaagtccaaaaccttcttctaggatcaacatagggtctactatcaagtcttcaaaatccatctttttttcttcttttttatccctaaatataagaagagagagaaaaagatagaggaagaaagctggtagaaagagatgtgagagagaagggagaaaaaaagaacaaaccaaatctctctctttctctcttcattatcttctttcttcaaaaaggggattttcccctttctccctctctttctcctagcggatggctaaggccagcagtctatggtggtgtctagtggtgaagatgcgatggccgcagtgctacagcgatggcagttgtcggttggtagtggtagtgggcgatccaatagaaagaaaaggaaatcaaaacaaaatagaaaaagaagccttgctttgatatgataagaagactacaaggtggtcagcggtaatgacaagcatccgcattagcttaacctcttatgatagttgcaaaggcaataatagccacagtggctgacggtggataaactaaagaaaacagaaggtccttagtgcggcaacatccgacggtcttccaagaagatttcagccaatgatggctgtatgaaaataaaaaagaaaaaaaggtaccaataagatgggaggccacgatgcctcgatcatctctaatgatggcgtgaccatggttgtgccaaaacttttttttcctatctttccagtgatatgatcaattgatcactgatcaatacagtggaagcttggctttataaatgatggaggctagggttttctagcctccgatgagttggagaaggagccagagtcaaactctttcttcgactcaaataggggaagggaaggtctttccttccttcccattgtttcttgggcttgatgagatttttattttagaaaaatttcaagcctctacaaccatatgaaatcataatgtcaaagctagaaaaggagatctatgccataatattccaattccaagcctaatcaaagaaccatcaatccattaacactaactttaagatacctaagttctccctagcattatctatggtaagaaaatctattaattaaaattgcataattatatctaaatcagtcaaagaacaaataatattctctctttctttatcaaaattatactcctttaccaggaaactaattcgaatcttccataatatcttttggatcaaagaattaatgtatttaattagtttcaaaataactcaaaccatcacacttctgctatacactctaatctaaatccatcgattcctctgggttgactaggtgaattctaacaaaataccgcttaatatcggaaccaagaagatccaaaattttaacttaaggcaaactagaacaaaacttttgcatctttttatccttacaaaatcttgagcataccacatcaaaagtaaaccttgagccactatccatgtttgaagcatgacataagcttcgccatcctctcaaaacttaataactctagataaatttaaattaatcctgacttctctaacagttcaattagactatcaagatcaccttttctcttggaaagttaactcaaaattctaacaagttagaaaactctaaatcaacattcttattaacttgtttattttttatagagcttcgttcactacaattcttagtatcaatcgacaaaccacatgaacgccccttatatgttagacatatacaagtccaccagaatcaatttctctactcaattaaatatcgatagcaagatactatagacctgctcataagcctaactctgattagaatttaacacatccaactatctccaacaaatataagaaagaccaagtaagctgatctaaagatgataatttaaattatcaaagattctaccaagatgcatatctcatatccaattgataaaatctaatccattaatagaatcaaacatacttttcttttacatgccagtttcatatatgatcttcttataggtttgattctcgaagaatgtttatttttaacactatgtaattctttcttaggccatatcctaaacaacttgctagtaaagtctaaaattttaatgatcaaacaattaataataaaattaaaaaagttattatgatctccccctatattaagtttagaatttcaaaaatatctaagtgacaattgagcaagtacacacagcataacacaatctaccaatatatcatactttattctagggtctacagctcctatacttaggtcaaatcttacttattgaaattagagacataacttatccattccttttgtactcataatatgccaagtcttatgcataaatttttatcataatgcttagtgagcttaaacctgagctttgaatctatttctactatgtacattacatccctagtgatcacaactttaagttcaaatatcaattaagttataatccctaataatcataacctagctctgacactactttgtcatatctcgatcccagcatctggattggccacatgatggccgtatactttctaggacaagatcctaaagaatatgcaagattttaaattcattacaatcttaaaatcccatgagtactattgatctgaattcaaaatgaatattacacattaacaaataccaaaccttgtataatttataaaatttgatcatctgattggtattgatgatattccatctaatcaattctttcaaccttgatcccacctatagtaaaatacatatatcctattactctgaaaatgaaaagaaagatgtgagcttcatagatcagtaagaattttcacacatcaatattaatataataataaataaaaaattatcaatagttattactcatataaatctcatacaataggatatcacgatcataaaatatatataaaaaaatatatttttttgtataataaatcacatcaaatacttttctcaatttatagtgtatcagatcctataatatttaggtgctaggctctaaattattacaactatattttccactcatggcatgacatcgacatagtggctaatctcgtggactatcacaatcacatttttagcatgaggttggacataagcatagtggctaatctagagggtcataagtgctcaactctgactaccacaatcatatttatagtccatattgggatatcaataaaatggctagttcagaaaactacaagtactcaactctaaactatcataaccattttctagcccataatgatgcatcaacaaaatagcaagcctagagcaccacaatccaccattcaaggacacaattcaattaataatttaagatcatatttctttgtaaaatttaatacataaaattaccaaaaccactcaagttgggataagtgacatgtgatatataactttatacagaatcatatatatacttaagaaataaatgtatagcatataactatcaaaaactatatagatcaaaatcattaattcacaaaaataatttttatataaatagatgattattatccagaaattcttatctctactaatgacaaactcggttacaactattttcttgtccatgcctaatatatccaaccaatcaacataattccaactcatccttaatcaaccattagcataaaaaataaataaattactcatagtgttttaatttcaaagctttaatatccaaattaatcttaaatctaatttttttgtactttctaatttaaaattatataattaaataagaaattaagattttatcttgacttgtaaactaaagcataacatttcttgctttgcattttcttattgggatgattgctctcatccaaaatcaaaaccaacaatcaaaaaaagctataaaatagttattgtcgatggtggaaaacttagaagaagaacagttggtcgaataataacatccgatggcccaagtgggtttgatctagatgccttagctagtgattcaagaatatgacaaagatcgtctatgatgggtttcgtggttacttgatcaagatcaaggtgaagaagggcaagattagtaggatccaatgaccagtgtcagcccatctaggtgatccaaatgattaatctataattaagagccaaattatagctcaatagaaatttggcgatgataaaatccaacaatgcccggcaagagtcgggttaggagtgaacaattatagagcaaacctagaatcttcttttgggatcaacctagggtctaccatcaagtcttctaaatctatctttctttcttttttttttatgcctaaatccaagaagagagataacaataaagggagaatgtagagagagatgtgagagagggaagaacaaatcgaatctctctctctcttccttgtcttctttcttcaaatagaagattttcctttctccctctcgtcctccaaacatggcagtggatggctgaggccaatagcctgcgatggcatccaacagtgaagaggcgacaaccccagtagcaacaatgatggcagctggtggcagcagtgggcaatcggatataaagaagaagaaaatcaaagcaaaataaggcaagaggccttgctttgatccaatgaagaggacttcaaggtaatcggtagcaatggtaagcatctgcaccagctcaacctttggtaatggtcgcaatggcaataatggccatggtggccaatggtggatgaatcaaagaaaataggggatccttggtgcggcaagatctaatggtctttcaagaagatcttagccaacaatggctacacgaggataggaaggaaggagagaaagtgcccatgagatgggaggcgatgcctcatctcctatgatggttcaaccacgattgggctaaaacttttttctcctccttttttgacaatgcaatcaattgatttctcaatagaatggaagctcagctttatagacaatggaggctaaggtttcctagcatccaatgagtttgagaagaagcaggagtcggactccttcgactcaaacaaaggaaaggaaggtctttccttccttcctattgtttcttgggcttgattttgggcctatttcgatgatgggctgggtagggtatcacaacagttttgtttctaaattgtcattatcaggaagagtaattctttgtacaccacattcgatgtagaaaaactgcaccactccgcctaattgagccacatataaccaccacttttcaatgtaatttagtattcgcaattctgcttttttttttgaaattttgaatggcaaaaatgtccatcctcttttaaaaaaatatgatatcttatggccatattataatatcctgcaatcaaattatgatttcttatatacagaaagttataatttgaccacaggatgtcataagaaaggggtggacattttcatcatttaaaaatttttaaatttttaataatgaaaatgtcctttcctttttatgacttttggaagaaaaattatgacatcctatgtgtattaagacataatttgaccgcaaaatgtcataatttttttaaaaaaggataagcattttcatcatgcaaaatttcaaaagaaaaagcagaaatgcggatattaaatacacattggaaaacggtgcattacatgactcaatcagatggcgcggtgcattttttctacaccaagtgcggtgtacaaagaatttctcttactaggaaatatcttgagtctagaccggcccatttgtcatttagaccaatcaaggactatgaattttggtccataataagtatgagatcgtcatgggattgaaaaagatgggaaataactcctcagtttgccccttgacagctcacaattcttcaaataatagcataaatcattttttgaatcatcaaatttattacattttagccttttagaagaaaccaatgctatccatataaaaggtatttgttttctattaatgtcattgcactaatgaagacagcttcagcaaagatagagcagaaatcctttaaattttgtaagattcatttgatcatcttgaattttctttgatgatgtggttgcagcaatactatcagcaggaatcagcaaagttgcgccaccagatacagattttacaaaatgcaaacaggtgaacctcaaacttagatcagaactgattggtctcaaatacaatgtatatgcattttcaaagcttaagattatgtcttaccatgattcctaatctaccacctctacctttcaggcacttaatgggtgaagctttgagcactctgactgtaaaggagctcaagcaactcgaaaacagacttgaaagaggtatcacacggatcagatcgaagaaggtaatctgcatctatattttcttcaaactgagatcttcatattgccaccagcacatggcttatctgaagtacatgattattaatcatgaaacatcatgctatgcagcattgaaaagggaaatcattgtggttcacaggtgggggtagagcatgtaagatacgatgggatctaaaaatcgagtcaatataaataagtgtaatttgtattctgttctgcccccagaaatcagcataggcaccatgatgcatgtaccatcacctaataatatgcaacttcagaattttttggcccatccagctctttaatttgatttttgatgcatctcattgtttttttcgcatcagcatgagctgttgtttgcagagatcgagtatatgcagaaaagggtaatattctaaacttattccctgcaacttaattcaaagtattgatttctttcattcatgtctccctctgagtggttctttgttgttgaactgtaggaagtagaactccaaaatgacaatatgtacctcagagctaaggtatcaatgagaacaaaactctcttccttgtccttgtctgctatttctttctgatataaacaaaagaaatggatatcatattcgtaaaatatttgatatcatctatcatgcttttagacttatatgtggtactagcatggagccaaattatatgcattttcatatgtttagaatgcatgactaacgaaacagtgacttatgtttaaaatgcattttctcattgatcaaatttttttttacatactgttgaatttaacagaggagaatagtttccaagagatattacaaaacaagagtttatttgtatttgcttgtcttcaagaaatgaattcagctccactagtggtaatcatgtggtcatcatccatagtggcctgtatggcatggcataaaaactaggtgagattgtaaacaatcttcatgatgatagtatatatatcatagaacattgagcctttgtgtggaggctcatctgaaaattagtcatatctgaatgagaaccagattgatggaccgtttgaatcaagagataggacaagcaatactcgaaaaagtgccttagttacagcccaaattctggattgctgatttctctatttatcgatgcaccaacacccttcatgggcaagaatattgtttaaatcagtgttgcatttgacttcaaacctctaacatctcaacaaccataactgaagccccttcaaagctaaaatgcctgttaatttgttcttcacaaagaaaatggcattttttcctagatgtccataccgatactaacggtattttggaggcttgatgatgtgctaatgacactttggattcctcaaagaaatggctcctctgctccatctcggtcacaagtctctaaaattttcacttgttgtttccattgattctatttctttatattttatttagatcttcacagacacagtctcaaagtagcaaggtggcatctacattcttatttctcacttcaaaatttttggtgttctcagatagcagagaatgagcgagcacagcaagcaggtattgtgccggcagggcctgattttgatgctcttccaacgtttgataccagaaactattaccatgtcaatatgctggaggcagcacaacactattcacaccatcaagaccagacaacccttcatcttggatatgaaatgaaagctgatccagctgcaaaaaatttactttaagtatgtcgctgcttgttaatgacatgttctaataacataggctacaagacctgtactcttactgataaaggtgtgttagaagacttgtctgatttctatattcctaatatcaatagacatgttagtgtgccttaatttgtcttgatttcagtaatattttgcagattggaagaaaaagcacttttttattcatagaagttctctccaccaaccatcatctattgagtagatcagagtagcataaatgacatgtgtatgcatatcctagagctataattgacatgccaaatgaaaaacctaaaatgctgaaaggaatctccacaattatggaggaattagtacttcttagaccacgaagctaaaactagatctgcaatcctcataaagaatggctaccccctactgccgagtgtcaccaaaacattattgaagttgctaagccaagccctcaaagttctcttttgctatgtttctccccagctgcgagcttttgattttgttgcttcttcaaagatcatgtacatgtaagtggtttcttttgctgctgtctctcggatctttttgcgtgatgcatataggcctggtagatcaccaaaaccagactcgccatttgtgtaagtccaggttttccagtagtcctgtgattcttgcctccagctaatgctttagcagaccattgcaagcaaatctctgtcagcaactatatggtcacttggagtagatggatattaaacatgcttgtctttttgcttatagccttcaatttatttgatattatagtattaacccaagctcaagctcgactcgatgaaaaatagacaaaactcgagttgagcttgaatatcaatggagttatactcgagttcgagatcaagtcttagcttactaataagatatatatatatatatatatatatatatatatatacaaactcaaataggctcataagttttttaaactgagtatcctgttattcaaggttgataataatcgagttgagtcaagcttgaatagtttataagcaactttgactcatttgtatacatcgtaagcttctaaagatagccataagagatcagagatgtccatgcctgtggtaccaacctatggtaagcattaaggagggtggtaccaacctatcggctgaagtttcgttggtgaatgttaatttttgcaaatctctaacactataatataaaaatctctaggatcttacatggtcaaaaatggttgtagacgttatatgctaaataatgtgttgttgtccatgtcaggatctaatgaagaataaccacttgttttgttgtgagaatctaatcagtgtagtgctatacaagccaatgatctgtatttaattagctcccagttgctagatggaatcgtactaaagttttttttttttggattgaaggtactaaagcatttaaaaataaaaaatttctcacaatccggcattagcttagttggtagagcagaggactttagttggtattaatcagcaatcactaggtcgcaggtttgaattcggcaagttagattttttaaattaaatgccaattatttgtagttttttctaaacaatttgacactatttttcaaaattatgcaagacaaaaattgaaaaattccaaggtgtcatgttatcctttaaaatttttacatcataaactttaaattataatttacaaatatttatttcatttacaacaacagaacatatagcatgagaagaattatgcaaaagaataactaagaatttctgataaaatatacacctttttctgaccccaatttatatcactaaattcaaagatgaggattatgcaatgttggagctagtatggctgaaaatctaacatccttgctaagcatttctgctttaggaaggctaatattcttgaaaaaacaaaataattggcttggggtttaagacagcttcaaactgggagtggcttacatgtatacaatcagaactactataaaagccatggaagcaggatgggaaaaaagaaaatgatttagtaattttttatttatatttaatttttttttattaagctatcaactatttccctaaatatcataagacccacatcaaagctattaaaaacaaataaaggttttgcatcaatgtattgggtacatcccaatcttatttctcaaaaatgtttttgtgtcaacacatctaacaatatcattgtcaaacttttatataaagcacctactacacaagctatactacactctgcaagttaaacccatttatttatcaattttctgccaaattatttattaattatttaaacaaaaaatttaaattactataatgctaaacaattttatagctacttaaaagaagcatgttcggttgctaaactatctcacttgcacatatcttccgtatactttatatcattccaaatttttttcataggacttatttggacaatcgggaaacatgttttctttactatgaaattgcattcaagagtattgacaaatcccattgtcttttttattactaaatatgcattttgtatgctcatatactagtacataaatctattggttttttattctcttggttagtataaattgactatctcaagatagcaattaatatgtattatattattcaatacttttaatcttgcctttgctatgccgcttttagtttctttaatattaaatatcaaatgaaatgataactaatctcattttagtgatattgcctgacattttgatatcctattcttcaatatcacttgagatatcaagatatcttgactatttaagatctattttctattgaaatgaaggtaaattggtatgttggtttgtcttggttagaaatgaatttgagacttaaaatttcaatagaatttgatgaatgatttaacctgaatatataaaaacagcacgcaagttagctgatattcatccttttgatcttgtttcaaattatttatcgggataattgatatttatgtatttataaaacaatattacaggtaagagaaatcaaaatacaatgattcactccacattcctatcctccacatccaaaactcctcaaaattaaaaccaaactctaaaatgctctctatatattaaaatttcaatgtagcttttgataatgttataaaaatagttgttttgatataaatggttgttgaagctcatatggatgatcccttagaaactggagtgtattataaatgatcgttgaagctcgtatggatgatcccttagaaactggagtgtattataaatgatcgttgaagctcgtatggatgagtccttagaaattgatataagaaatattatttccttcaaatgaaaaatattattcccttggtaaataaataagaaatattatttcttttgtaaataaatgaaaaatattatttttctttataatttagattaaaaatctataaaagagcttggaatgaaatgagaattgttgcggccaactctccgtcgcctgtcgccggtaacgagcacccgcaagacagcatccacatagaccgaattgatgtccgacgaagaccctccgatgcttaagtcagataaggaagttgatgaacaataatttttgaatgtagaaagtagcagagttctggccctgagatggcttaccagtactgctcacttaacccctttttatagatgcttttgatgtaaccgtcgagcacatagtcccactttttatgacgctaaattatcgggccataaatataaaattaatgaggcgttaattctccttaatagccgtgacacacagttgataaccgtttgtgacggttatgatatgttgagcagattagccgatcatatatcggtagaaccgactatatgtcggtagaatctatgagcgaccatcggctagtagttctgttatgccgacggtctaagtcattcactgtcgatcggtagtagtcgaatcattagtcggtcagccgatagtaagtcggcgcggttcgctcagtcggtcgatgaagagtcagaactgcatgttcaaccgatatgcagttggagtcgtggtgaccaaagtctgaggtcggtcagtttaccccaacagttacccccactctcaaagtccaaggtgaaccgacgtgtatattgtcacgtagttcgtcatattagatgaagggagttatttctatcatatcgaacctcgattttgatgtcgctttcttcgagatatgggcgatcgactgctttgtcgttgtggcggatacggtcatctttaaactgtcacactaatcagacgattcggtatcagttgtcagtgtcagacatcattttggaaaatcaattcgacgtcggatgatatgattctgacaaatagatttgtgccatatgtctgaatgttattgggtcggatctgtttacgcggattaggatgacgtggctcgatctggggcaaatacgtcgaaccatctgattaatggtcggtctagatgttgccacatgtcacatctgataaattttcgattcaatcaccttcatctccactgttgagggatcctatatatataggatcgctctcaaccaaacttctacttttcattttatctttcttggtgccgaaactctgtcggacagtcgtcccaacgtctgaggttgttattttcgtctttttcagatcaagtttctgtcttttcttgagtcctttttctttcagaatctccgtcttctttagaatcttgtctcttatggctaggacttcttcttgggacggtcggttggagaatccgactgacgaatctcaatcagatccagaggttgaggtttcttcacttttggagtcaaatatcgagcagcttcaggaacagtattgtatcccggagcagtttcagctttttgcccctagggctgatggtcggatgaatatcccttttttgggccaggtggccttctatgtcgaagattttcgagtggatcttcgatttttgattttaaaatttatccgaaatattttggattactacggactttgtctggctcagctggcaccgaacttgatctggctggtaattagttttgccttgttgtgtcagttgctaccgactaaacctcgtccttctctttttcgagttttcttcatcctccgacctcatccgaagatccgagggtggtggttcttcaaccctcgaaaagatttttcttttattactgatcttctatcatccattcatagatggaagaatcaattcttcttcgcttcctctacccttccttggggttttccttctcgttggagcgatctacgaactgattgcacgacaacagccgagtagagattgacgatcgggaggacttccattgactgaaagacatgacggtcctggcacagaaggagcttgtgaacgaacagaccctttatgatgccgaccttagttcgattgcccgattagatatagtacagtcggtcggttatttcggactttacttttcttttacttgtttagttgtactgacttctattgtaattgcagccatgtagccgagggtgcgagtgtcgagcatcgatatttgtcagcacgctgccaggaagagggcagcgtccgaggttggaccttctcgaccatcgatgaggcatcatactttggtgcaagttcgagcggcactagcttcagtcgtcgcttcaatgccgactgaggaacccgatgctccatctgcatcggttcctgagccgatcccgatactatcagccccgacagtgctccctgctgcatcatccgaagaaagggtggcaaggagaactgccgaagcaccatcggtagttccatcaattgaggaggtttgggtcagggctggagaatctgaacaatctgtggctgcgccagttgctccttcagctggggcgcagtcgagttcaagttttccctcgctttcgaacatgggactgccggcaagggatcgggggaaagctctggtgacttcgacggaagatgcagcatcggagggctacacggttcacttcgaccttcaagtacctgatgataaattgaccctggccaatccgacattggccaagcgactgtgccaagccgctcttccttcgctttatcaggagcatcgaaagaaacggacagtggccgagatgttttcatccttttacttgatgataattagggtaagtttcttttcttctttttttcttttttttaacctaa

SEQ ID NO: 8220 - protein, 181 aa, Elaeis guineensis
  predicted shatterproof1 (SHELL) dura protein
MGRGKIEIKRIENTTSRQVTFCKRRNGLLKKAYELSVLCDAEVALIVFSSRGRLYEYANNSIRSTIDRYKKACANSSNSGATIEINSQYYQQESAKLRHQIQILQNANRHLMGEALSTLTVKELKQLENRLERGITRIRSKKHELLFAEIEYMQKREVELQNDNMYLRAKIAENERAQQAA

SEQ ID NO: 8221 - protein, 181 aa, Elaeis guineensis
  predicted shatterproof1 (SHELL) pisifera protein, Zaire allele
MGRGKIEIKRIENTTSRQVTFCKRRNGLLKNAYELSVLCDAEVALIVFSSRGRLYEYANNSIRSTIDRYKKACANSSNSGATIEINSQYYQQESAKLRHQIQILQNANRHLMGEALSTLTVKELKQLENRLERGITRIRSKKHELLFAEIEYMQKREVELQNDNMYLRAKIAENERAQQAA

SEQ ID NO: 8222 - protein, 181 aa, Elaeis guineensis
  predicted shatterproof1 (SHELL) pisifera protein, Nigerian allele
MGRGKIEIKRIENTTSRQVTFCKRRNGLPKKAYELSVLCDAEVALIVFSSRGRLYEYANNSIRSTIDRYKKACANSSNSGATIEINSQYYQQESAKLRHQIQILQNANRHLMGEALSTLTVKELKQLENRLERGITRIRSKKHELLFAEIEYMQKREVELQNDNMYLRAKIAENERAQQAA

SEQ ID NO: 8223 - DNA, 50 bp, Artificial Sequence
  synthetic oil palm SHELL locus dura allele of Angola (0.311/368), Congo (0.212/70), Madagascar (0.240/01), Nigeria (FK7/005) and Tanzania (0.256/235)
gccgaaatggactgctgaagaaagcttatgagttgtctgtcctttgtgat

SEQ ID NO: 8224 - DNA, 50 bp, Artificial Sequence
  synthetic oil palm SHELL locus pisifera allele of Angola (0.311/191), Congo (0.182/77) and Madagascar (0.240/34)
gccgaaatggactgctgaagaatgcttatgagttgtctgtcctttgtgat

SEQ ID NO: 8225 - DNA, 50 bp, Artificial Sequence
  synthetic oil palm SHELL locus pisifera allele of Nigeria (FK7/104)
gccgaaatggactgccgaagaaagcttatgagttgtctgtcctttgtgat

SEQ ID NO: 8226 - DNA, 50 bp, Artificial Sequence
  synthetic oil palm SHELL locus tenera allele of Angola (0.311/415), Madagascar (0.240/05) and Nigeria (371)
gccgaaatggactgctgaagaawgcttatgagttgtctgtcctttgtgat

SEQ ID NO: 8227 - DNA, 50 bp, Artificial Sequence
  synthetic oil palm SHELL locus tenera allele of Nigeria (Palm T128)
gccgaaatggactgcygaagaaagcttatgagttgtctgtcctttgtgat

SEQ ID NO: 8228 - DNA, 50 bp, Artificial Sequence
  synthetic oil palm SHELL locus tenera allele of Nigeria (88)
gccgaaatggactgcygaagaawgcttatgagttgtctgtcctttgtgat

SEQ ID NO: 8229 - protein, 58 aa, Artificial Sequence
  synthetic oil palm SHELL locus out group of A. thaliana (P29381.1)
GRGKIEIKRIENTTNRQVTFCKRRNGLLKKAYELSVLCDAEVALVIFSTRGRLYEYAN

SEQ ID NO: 8230 - protein, 58 aa, Artificial Sequence
  synthetic oil palm SHELL locus out group of A. thaliana (AEE82818.1)
GRGKIEIKRIENSTNRQVTFCKRRNGLLKKAYELSVLCDAEVALIVFSTRGRLYEYAN

SEQ ID NO: 8231 - protein, 58 aa, Artificial Sequence
  synthetic oil palm SHELL locus out group of poplar (XP_002327282.1) and tomato (AAM33101.2)
GRGKIEIKRIENTTNRQVTFCKRRNGLLKKAYELSVLCDAEVSLIVFSSRGRLYEYAN

SEQ ID NO: 8232 - protein, 58 aa, Artificial Sequence
  synthetic oil palm SHELL locus out group of grape (XP_002281890.1)
GRGKIEIKRIENTTNRQVTFCKRRNGLLKKAYELSVLCDAEVALIVFSSRGRVYEYSN

SEQ ID NO: 8233 - protein, 58 aa, Artificial Sequence
  synthetic oil palm SHELL locus out group of peach (ABG75908.1)
GRGKIEIKRIENTTNRQVTFCKRRNGLLKKAYELSVLCDAEVALIVFSTRGRLYEYAN

SEQ ID NO: 8234 - protein, 58 aa, Artificial Sequence
  synthetic oil palm SHELL locus dura allele
GRGKIEIKRIESTTNRQVTFCKRRNGLLKKAYELSVLCDAEVALIVFSSRGRLYEYAN

SEQ ID NO: 8235 - protein, 58 aa, Artificial Sequence
  synthetic oil palm SHELL locus pisifera allele of Nigeria (UP0323 - T128) and (GGN37 - Other) and Angola (0.311/460)
GRGKIEIKRIESTTNRQVTFCKRRNGLPKKAYELSVLCDAEVALIVFSSRGRLYEYAN

SEQ ID NO: 8236 - protein, 58 aa, Artificial Sequence
  synthetic oil palm SHELL locus pisifera allele of Angola (0.311/191), Congo (0.182/77), Madagascar (0.240/34) and Tanzania (0.256/238)
GRGKIEIKRIESTTNRQVTFCKRRNGLLKNAYELSVLCDAEVALIVFSSRGRLYEYAN

SEQ ID NO: 8237 - DNA, 477 bp, Artificial Sequence
  synthetic oil palm SHELL exon 1 reference pisifera genome sequence
ttttgatctatggaaattaataagtcaatatgtcagtatgtgaaggtctaggccatgttagtcccatcatttcatttatagtttagatgatgattttttctttgttcttggcaatattctagaccaacttcagcagacagaggtgaaagagagatcatgggtagaggaaagattgagatcaagaggatcgagaacaccacaagccggcaggtcactttctgcaaacgccgaaatggactgctgaagaatgcttatgagttgtctgtcctttgtgatgctgaggttgcccttattgtcttctccagccggggccgcctctatgagtacgccaataacaggtatgctttgatgacgccttctcttccttcgctcatatcaagttaattttatggcttcatttgttctatggccaagccaaattctttttaaagttctagaatgttaatgatggtagttttgctcctcttcaatttattt

SEQ ID NO: 8238 - DNA, 25 bp, Artificial Sequence
  synthetic Exon 1 forward PCR primer
ttgcttttaattttgcttgaatacc

SEQ ID NO: 8239 - DNA, 25 bp, Artificial Sequence
  synthetic Exon 1 reverse PCR primer
tttggatcagggataaaagggaagc

SEQ ID NO: 8240 - DNA, 23 bp, Artificial Sequence
  synthetic 5' M13 forward sequence tag
gttttcccagtcacgacgttgta

SEQ ID NO: 8241 - DNA, 19 bp, Artificial Sequence
  synthetic 5' M13 reverse sequence tag
aggaaacagctatgaccat
